US006933145B1

(12) United States Patent
Moyer et al.

(10) Patent No.: US 6,933,145 B1
(45) Date of Patent: Aug. 23, 2005

(54) MATERIALS AND METHODS FOR DELIVERY AND EXPRESSION OF HETEROLOGOUS DNA IN VERTEBRATE CELLS

(75) Inventors: Richard W. Moyer, Gainesville, FL (US); Yi Li, Lazal (CA)

(73) Assignee: University of Florida Research Foundation, Inc., Gainesville, FL (US)

( * ) Notice: Subject to any disclaimer, the term of this patent is extended or adjusted under 35 U.S.C. 154(b) by 0 days.

(21) Appl. No.: 09/662,254

(22) Filed: Sep. 14, 2000

Related U.S. Application Data

(63) Continuation-in-part of application No. 09/086,651, filed on May 29, 1998, now Pat. No. 6,127,172.
(60) Provisional application No. 60/224,479, filed on Aug. 10, 2000.

(51) Int. Cl.$^7$ .................... C12N 15/87; C12N 15/00; A61K 48/00; C07H 21/04
(52) U.S. Cl. ................ 435/320.1; 435/325; 435/455; 424/93.2; 536/23.1
(58) Field of Search .................. 536/23.2; 435/320.1, 435/325, 455; 424/93.2

(56) References Cited

U.S. PATENT DOCUMENTS

| | | | |
|---|---|---|---|
| 5,721,352 A | 2/1998 | Moyer et al. | ............. 536/23.2 |
| 5,753,258 A | 5/1998 | Schreier et al. | ............. 424/450 |
| 5,762,924 A | 6/1998 | Dall et al. | |
| 5,935,777 A | 8/1999 | Moyer et al. | |
| 6,106,825 A | 8/2000 | Moyer et al. | |
| 6,127,172 A * | 10/2000 | Moyer et al. | ............. 435/320.1 |

FOREIGN PATENT DOCUMENTS

| | | |
|---|---|---|
| WO | 9413812 | 6/1994 |
| WO | WO 96/09074 A1 | 3/1996 |
| WO | 9850571 | 11/1998 |
| WO | WO 99/61069 A1 | 12/1999 |

OTHER PUBLICATIONS

Marshall; Gene Therapy's Growing Pains, 1995, Science, vol. 269: 1050–1055.*
Orkin et al.; Report AMD Recommendations of the Panel to Assess the NIH Investment in Research on Gene Therapy, 1995.*
Afonso, C.L., E.R. Tulman, Z. Lu, E. Oma, G.F. Kutish, and D.L. Rock [1999] "The genome of *Melanoplus sanguinipes* Entomopoxvirus" *J. Virol.* 73:533–552.
Arif, B. M. and Kurstak. E. [1991]. The Entomopoxviruses. In "Viruses of Invertebrates," E. Kurstak, Ed., pp. 179–195, Marcel Dekker, Inc., New York.
Bawden, A. L., Li, Y., Glassberg, K., and Moyer, R. W. [2000] Entomopoxvirus Vectors. In "Viral Vectors: Basic Science and Gene Therapy," p. 341–355, A. Cid–Arregui, Ed., Eaton Publishing, Natick, MA (In Press).

Bawden, Alison L., Kathryn J. Glassberg, James Diggans et al. (2000) "Complete Genomic Sequence of the *Amsacta moorei* Entomopoxvius: Analysis and Comparison with Other Poxviruses" *Virology* 274:120–139.
Berns, Kenneth I. and Roy A. Bohenzky (1987) "Adeno–Associated Viruses: An Update" Adv. Virus Res. 32:243–306.
Fernon, C.A., A.P. Vera, R. Crnov, J. Lai–Fook, R.J. Osborne, and D.J. Dall [1995] "Replication of *Heliothis armigera* entomopoxvirus in vitro" *J Invertebr. Pathol.* 66:216–223.
Gauthier, Laurent Francois Cousserans, Jean Claude Veyrunes, Max Bergoin (1995) "The *Melolontha melolontha* Entomopoxvirus (MmEPV) Fusolin Is Related To The Fusolins Of Lepidopteran EPVs And To The 37K Baculovirus Glycoprotein" Virology 208:427–436.
Goebel, S. J., Johnson, G. P., Perkus, M. E., Davis, S. W., Winslow, J. P., and Paoletti, E. [1990] "The complete DNA sequence of vaccinia virus" *Virology* 179, 247–66, 517–63.
Gooding, L. R. [1992] "Virus proteins that counteract host immune defenses" *Cell* 71:5–7.
Goodwin, R. H., J. R. Adams and M. Shapiro [1990] "Replication of the entomopoxvirus from *Amsacta moorei* in serum–free cultures of a gypsy moth cell line" *J. Invertebr. Pathol.* 56:190–205.
Granados, R.R. (1981) Entomopoxvirus infections in insects, In: Pathogenesis of invertebrate Microbial Disease, pp 102–126, Davidson, E.W. (ed.) New Jersey, Allanheld Totowa.
Gruidl, M. E., Hall, R. L., and Moyer, R. W. [1992] "Mapping and molecular characterization of a functional thymidine kinase from *Amsacta moorei* entomopoxvirus" *Virology* 186:507–516.
Hall, R. L. and Hink, W. F. [1990] "Physical mapping and field inversion gel electrophoresis of *Amsacta moorei* entomopoxvirus DNA" *Arch. Virol.* 110:77–90.

(Continued)

*Primary Examiner*—Anne Marie S. Wehbé
(74) *Attorney, Agent, or Firm*—Saliwanchik, Lloyd & Saliwanchik

(57) ABSTRACT

The subject invention pertains to recombinant entomopox vectors which are useful for the delivery and stable expression of heterologous DNA in vertebrate cells. Specifically exemplified is a recombinant EPV from *amsacta moorei* (AmEPV). Because of the capacity of the EPV to incorporate foreign or heterologous DNA sequences, the vectors of the subject invention can be used to deliver DNA inserts that are larger than 10 kb in size. Accordingly, one aspect of the present invention concerns use of the recombinant vectors for delivery and expression of biological useful proteins in gene therapy protocols. In addition, the subject invention concerns novel AmEVP polypeptides and the polynucleotide sequences which encode these polypeptides.

22 Claims, 10 Drawing Sheets

(5 of 10 Drawing Sheet(s) Filed in Color)

OTHER PUBLICATIONS

Hall, R.L. and R.W. Moyer [1991] "Identification, cloning, and sequencing of a fragment of *Amsacta moorei* entomopoxvirus DNA containing the spheroidin gene and three vaccinia virus–related open reading frames" *J. Virol.* 65:6516–6527.

Hall, R. L. and Moyer, R. W. [1993] "Identification of an *Amsacta* spheroidin–like protein within the occlusion bodies of *Choristoneura* entomopoxviruses" *Virology* 192:179–187.

Hall, R. L., Li, Y., Feller, J. A., and Moyer, R. W. [1996] "The *Amsacta moorei* entomopoxvirus spheroidin gene is improperly transcribed in vertebrate poxviruses" *Virology* 224:427–436.

Kaplitt, Michael G., Paola Leone, Richard J. Samulski, Xiao Xiao, Donald W. Pfaff, Karen L. O'Malley, Matthew J. During (1994) "Long–term gene expression and phenotypic correction using adeno–associated virus vectors in the mammalian brain" Nat. Genet 8:148–154.

Kotin, Robert M., R. Michael Linden, Kenneth I. Berns (1992) "Characterization of a preferred site on human chromosome 19q for integration of adeno–associated virus DNA by non–homologous recombination" The EMBO Journal 11(13):5071–5078.

Langridge, W.H.R. (1983) "Detection of *Amsacta moorei* Entomopoxvirus and Vaccinia Virus Proteins in Cell Cultures Restrictive for Poxvirus Multiplication" Journal of Invertebrate Pathology 42:77–82.

Li, X., Barrett, J. W., Yuen, L., and Arif. B. M. [1997] "Cloning, sequencing and transcriptional analysis of the Choristoneura fumiferana entomopoxvirus spheroidin gene" *Virus Res.* 47:143–154.

Li, Yi, Richard L. Hall, Richard W. Moyer (Dec. 1997) "Transient, Nonlethal Expression of Genes in Vertebrate Cells by Recombinant Entomopoxviruses" Journal of Virology 71(12):9557–9562.

Li, Y., R.L. Hall, S.L. Yuan, R.W. Moyer (1998) "High–level expression of *Amsacta moorei* entomopoxvirus spheroidin depends on sequences within the gene" Journal of General Virology 79:613–622.

Lytvyn, V., Y. Fortin, M. Banville, B. Arif, and C. Richardson [1992] "Comparison of the thymidine kinase genes from three entomopoxviruses" *J. Gen. Virol.* 73:3235–3240.

Moyer, R. W. [1994] Entomopoxviruses, p. 392–397, *Encyclopedia of Virology*, R.G. Webster and A. Granoff (eds.), Academic Press Ltd., London).

Nienhuis, Arthur W., Christopher Edward Walsh, Johnson Liu (1993) "Viruses as Therapeutic Gene Transfer Vectors", In: N.S. Young (ed.) Viruses and Bone Marrow, Marcel Decker, New York, pp. 353–414.

Palmer, Christopher, Davin P. Miller, Susan A. Marlow et al. (1995) "Genetic modification of an entomopoxvirus: delection of the spheroidin gene does not affect virus replication in vitro" *Journal of General Virology* 76:15–23.

Ross, Gail, Robert Erickson, Debra Knorr, et al. (Sep. 1996) "Gene Therapy in the United States: A Five–Year Status Report" *Human Gene Therapy* 7:1781–1790.

Smith, G. L., Chan. Y. S. and Howard, S. T. [1991] "Nucleotide sequence of 42 kbp of vaccinia virus strain WR from near the right inverted terminal repeat" *J. Gen. Virol.* 72:1349–1376.

Smith, G. L. [2000] "Secreted poxvirus proteins that interact with the immune system" *Effects of Microbes on the Immune System* 491–507).

Sriskantha, A., Osborne, R. J., and Dall, D. J. [1997]0 "Mapping of the Heliothis armigera entomopoxvirus (HaEPV) genome, and analysis of genes encoding the HaEPV spheroidin and nucleoside triphosphate phosphohydrolase I proteins" *J Gen Virol* 78:3115–3123.

Verma, Inder M. and Nikunj Somia (1997) "Gene Therapy—promises, problems and prospects" *Nature* 389:239–242.

Winter, J., R.L. Hall, and R.W. Moyer [1995] "The effect of inhibitors on the growth of the entomopoxvirus from *Amsacta moorei* in *Lymantria dispar* (gypsy moth) cells" *Virology* 211:462–473.

Geoffrey L. Smith (Mar. 1994) "Virus strategies for evasion of the host response to infection" *Trends in Microbiology* 2(3):81–88.

Mustafa, Amir and Leonard Yuen (1991) "Identification and sequencing of the *Choristoneura biennis* entomopoxvirus DNA polymerase gene" *J. DNA Sequencing and Mapping* 2:39–45.

* cited by examiner

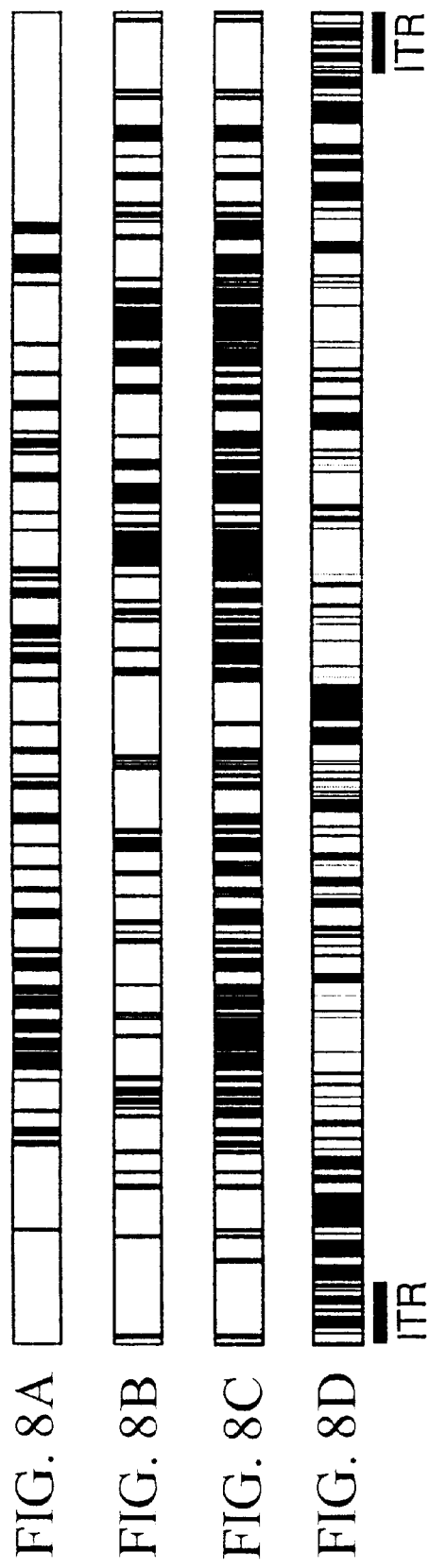

FIG. 10

```
 1 MNYYILLCLF MLFSSSYNFK LINNNICNED YDPGICRIGD
41 IRWYYNYNIK DCKIFIYGGC GGNMNNFNNY EDCINKCLI
```

MATERIALS AND METHODS FOR DELIVERY AND EXPRESSION OF HETEROLOGOUS DNA IN VERTEBRATE CELLS

CROSS-REFERENCE TO A RELATED APPLICATION

This application is a continuation-in-part of application Ser. No. 09/086,651, filed May 29, 1998, now U.S. Pat. No. 6,127,172, issued Oct. 3, 2000. This application also claims the benefit of provisional patent application Serial No. 60/224,479; filed Aug. 10, 2000.

The subject invention was made with government support under a research project supported by U.S. Department of Agriculture Grant No. 97-35302-4431 and National Institute of Health Grant No. P50-HL59412-01. The government has certain rights in this invention.

BACKGROUND OF THE INVENTION

Gene therapy is a powerful concept just now beginning to see applications designed to treat human diseases such as genetic disorders and cancer. The introduction of genes into an organism can be achieved in a variety of ways, including virus-based vectors. Viral gene therapy vectors can either be designed to deliver and express genes permanently (stable integration of a foreign gene into host chromosome) or transiently (for a finite period of time).

Current virus-based gene transfer vectors are typically derived from animal viruses, such as retroviruses, herpesviruses, adenoviruses, or adeno-associated viruses. Generally, these viruses are engineered to remove one or more genes of the virus. These genes may be removed because they are involved in viral replication and/or to provide the capacity for insertion and packaging of foreign genes. Each of these known vectors has some unique advantages as well as disadvantages. One primary disadvantage is an inability to readily package and deliver large DNA inserts that are greater than 10 kb in size.

To illustrate the problem of capacity of most gene therapy vectors, one need only consider adeno-associated virus (AAV), one of the most promising of the gene therapy vectors. Adeno-associated virus (AAV) is a parvovirus which consists of a 4.7 kb single stranded DNA genome (Nienhuis, A. W., C. E. Walsh. J. M. Liu [1993] "Viruses as therapeutic gene transfer vectors" In: N. S. Young (ed.) *Viruses and Bone Marrow*, Marcel Decker, New York, pp. 353–414). The viral genome consists of the family of rep genes responsible for regulatory function and DNA replication and the cup genes that encode the capsid proteins. The AAV coding region is flanked by 145 nucleotide inverted terminal repeat (ITR) sequences which are the minimum cis-acting elements essential for replication and encapsidation of the genome. In the absence of a helper virus such as adenovius, AAV causes a latent infection characterized by the integration of viral DNA into the cellular genome. The major advantages of recombinant AAV (rAAV) vectors include a lack of pathogenicity in humans (Berns, K. I. and R. A. Bohenzky [1987] "Adeno-associated viruses: an update" *Adv. Virus Rev.* 32:243–306), the ability of wild-type AAV to integrate stably into the long arm of chromosome 19 (Kotin, R. M., R. M. Linden, K. I. Berns [1992] "Characterization of a preferred site on human chromosome 10q for integration of adeno-associated virus DNA by non-homologous recombination" *EMBO J* 11:5071–5078), the potential ability to infect nondividing cells (Kaplitt et al. [1994] "Long term gene expression and phenotypic correction using adeno-associated virus vectors in the mammalian brain" *Nat. Genet.* 8:148–154), and broad range of infectivity. However, the packaging capacity of AAV limits the size of the inserted heterologous DNA to about 4.7 kb. Gene therapy vector systems are also needed that combine a large carrying capacity with high transduction efficiency in vivo.

Until recently, complex insect viruses (entomoviruses) had not been considered for use as possible viral gene therapy vectors. In the past, studies of entomoviruses have mainly concentrated on their use as biopesticides, expression systems or taxonomic novelties to compare to their mammalian virus counterparts.

The family Poxviridae comprises two subfamilies, the Chordopoxviridae (vertebrate) and the Entomopoxviridae (insect) viruses (EPVs). EPVs were first discovered in the early 1960's, and have subsequently been shown to have a worldwide distribution. The subfamily contains three genera; A, B and C, which infect beetles, moths (lepidoptera) and grasshoppers, and midge flies respectively (Moyer, R. W. [1994] Entomopoxviruses, p. 392–397, *Encyclopedia of Virology*, R. G. Webster and A. Granoff (eds.), Academic Press Ltd, London). It should be recognized that classification within the three EPV genera is based solely on morphological and host range criteria and not molecular properties. Indeed, it is now clear that the group B viruses of butterflies and moths (lepidoptera) and grasshoppers (orthoptera) are quite distinct from one another (Afonso, C. L., E. R. Tulman, Z. Lu, E. Oma, G. F. Kutish, and D. L. Rock [1999] "The genome of *Melanoplus sanguinipes* Entomopoxvirus" *J. Virol.* 73:533–552). AmEPV was originally isolated in India from the red hairy caterpillar, and it is the prototype virus of this group. This is primarily because of its ability to be easily grown in cultured insect cells, although certain *Choristoneura* and *Heliothis* EPVs have also been shown to replicate in cell cultures at low levels (Fernon, C. A., A. P. Vera, R. Crnov, J. Lai-Fook, R. J. Osborne, and D. J. Dal [1995] "Replication of *Heliothis armigera* entomopoxvirus in vitro" *J. Invertebr. Pathol.* 66:216–223; Lytvyn, V., Y. Fortin, M. Banville, B. Arif, and C. Richardson [1992] "Comparison of the thymidine kinase genes from three entomopoxviruses" *J. Gen. Virol.* 73:3235–3240).

EPVs are the most distant relatives of mammalian poxviruses and exhibit both similarities and differences to the more commonly studied chordopoxviruses, such as vaccinia virus (VV). Similarities include morphology, a large linear double stranded genome (previously estimated at 225 kb for AmEPV, 190 kb for VV), common transcriptional regulation sequence motifs, non-spliced transcripts and a cytoplasmic site of replication. Differences include the G+C content of the viral DNA (a low 18% for AmEPV, 37% for VV), optimal growth temperatures (28° C. for AmEPV, 37° C. for VV), and host range. AmEPV does not replicate in vertebrate cells, and VV does not replicate in insect cells, although both viruses enter their respective non-permissive cells and initiate a replicative cycle (Langridge, W. H. [1983] "Detection of *Amsacta moorei* entomopoxvirus and vaccinia virus proteins in cell cultures restrictive for poxvirus multiplication" *J. Invertebr. Pathol.* 42:77–82).

Generally, growth of AmEPV in insect cell cultures is similar to that of vertebrate poxviruses in mammalian cells. Receptors mediating poxvirus attachment and entry appear to be widespread and common, as EPVs infect vertebrate cells and VV infects insect cells (Li, Y., R. L. Hall, and R. W. Moyer [1997] "Transient, nonlethal expression of genes in vertebrate cells by recombinant entomopoxviruses" *J. Virol,* 71:9557–9562; Li, Y., S. Yuan, and R. W. Moyer [1998] "The non-permissive infection of insect (gypsy moth) LD-652 cells by vaccinia virus" *Virology* 248:74–82). It is assumed by analogy with the vertebrate poxviruses that AmEPV gene expression patterns can be classified as early, intermediate and late, but experimental data is minimal (Winter, J., R. L. Hall, and R. W. Moyer [1995] "The effect of inhibitors on the growth of the entomopoxvirus from *Amsacta moorei* in *Lymantria dispar* (gypsy moth) cells" *Virology* 211:462–473). EPVs have been shown to contain vertebrate poxvirus promoter elements and early transcription termination motifs (Afonso, C. L., E. R. Tulman, Z. Lu, E. Oma, G. F. Kutish, and D. L. Rock [1999] "The genome of *Melanoplus sanguinipes* Entomopoxvirus" *J. Virol.* 73:533–552; Hall, R. L. and R. W. Moyer [1991] "Identification, cloning, and sequencing of a fragment of *Amsacta moorei* entomopoxvirus DNA containing the spheroidin gene and three vaccinia virus-related open reading frames" *J. Virol.* 65:6516–6527). The most unique feature of poxvirus replication is development mostly, if not exclusively, within the cytoplasm. As a consequence of cytoplasmic development. EPV promoters (like those of vertebrate poxviruses) are recognized only by the virally encoded transcription system. The general availability of poxvirus specific promoters, coupled with exclusion of the nuclear transcription apparatus are major advantages for engineering and control of foreign gene expression related to gene therapy applications.

EPVs, like VV, contain a number of genes which are nonessential for growth in cell culture. Two examples are the thymidine kinase (TK) and spheroidin genes. The spheroidin gene can be viewed as a counterpart to the polyhedrin and A-type (ATI) occlusion genes of baculoviruses and cowpox viruses respectively. VV also contains an ATI gene, but it is defective. Spheroidin is the most abundantly expressed AmEPV gene, and serves to "occlude" infectious virions within an environmentally resistant occlusion body. Both the AmEPV TK and spheroidin gene can readily serve as sites for insertion and expression of foreign genes by utilizing standard plasmid-mediated recombination.

Entomopoxvirus (EPVs) productively infect and kill only insects (Granados, R. R. [1981] "Entomopoxvirus infections in insects," in *Pathogenesis of Invertebrate Microbial Disease*, p. 102–126, Davidson, E. W. (ed.) New Jersey, Allanheld Totowa) and can be isolated from *Amsacta moorei* (AmEPV), the red hairy caterpillar. Entomopox viruses and vectors have been described (See, for example, U.S. Pat. Nos. 5,721,352 and 5,753,258, the disclosure of which is incorporated herein by reference). Like other EPVs, AmEPV cannot productively infect vertebrate cells. Indeed, following addition of AmEPV to vertebrate (mouse L-929) cells at multiplicities up to 10 particles/cell, no changes in cellular morphology (as judged by phase contrast microscopy) are detected (Langridge, W. H. [1983] "Detection of *Amsacta moorei* entomopoxvirus and vaccinia virus proteins in cell cultures restrictive for poxvirus multiplication" *J. Invertebr. Pathol.* 42:77–82).

AmEPV infects vertebrate cells in a non-cytocidal manner and the infection is abortive. Like all poxviruses, the virus is cytoplasmic and does not normally enter the nucleus. A consequence of this unusual biology, is that all poxvirus mediated gene expression takes place in the cytoplasm in the infected cell. AmEPV promoters and those of the eucaryotic cell are completely different and cellular promoters are not recognized by the AmEPV transcription machinery nor are AmEPV viral promoters recognized by RNA polymerase II of the host cell.

BRIEF SUMMARY OF THE INVENTION

The subject invention concerns a novel viral vector system for gene therapy based on an insect poxvirus designed to deliver genes for integration and stable, permanent expression in vertebrate cells. In an exemplified embodiment, a recombinant AmEPV vector was constructed that contains heterologous genes under the control of promoters that drive the expression of the heterologous genes in vertebrate cells. The gfp gene and the gene encoding G418 resistance were used in an exemplified construct. The recombinant AmEPV was used to infect vertebrate cells and following infection the cells were transferred to media containing G418. Cells expressing both GFP and G418 resistance were obtained. Thus, the vectors of the subject invention can be used to deliver large DNA segments for the engineering of vertebrate cells.

The subject invention also concernscells that have been infected with or transformed with a recombinant vector of the present invention. The subject invention also concerns methods for providing gene therapy for conditions or disorders of an animal requiring therapy, such as genetic deficiency disorders.

In addition, the subject invention concerns novel AmEVP polypeptides and the polynucleotide sequences which encode these polypeptides. The AmEPV polynucleotide sequences of the subject invention encode a triacylglyceride lipase (SEQ ID NO: 1), a $Cu^{++}/Zn^{++}$ superoxide dismutase (SOD) (SEQ ID NO: 2), a CPD photolyase (SEQ ID NO: 3), a baculovirus-like inhibitor of apoptosis (IAP) (SEQ ID NO: 4), two poly(A) polymerase small subunits (SEQ ID NOS: 5 and 6), two DNA polymerases (SEQ ID NOS: 7 and 8), an ABC transporter-likeprotein (SEQ ID NO: 9), a Kunitz-motifprotease inhibitor (KPI) (SEQ ID NO: 10), and a poly(A) polymerase large subunit (SEQ ID NO: 11).

In addition, the subject invention concerns isolated AmEPV polypeptides encoded by the polynucleotide sequences of the subject invention, including a triacylglyceride lipase (SEQ ID NO: 12), a $Cu^{++}/Zn^{++}$ superoxide dismutase (SOD) (SEQ ID NO: 13), a CPD phololyase (SEQ ID NO: 14), a baculovirus-like inhibitor of apoptosis (IAP) (SEQ ID NO: 15), two poly(A) polymerase small subunits (SEQ ID NOS: 16 and 17), two DNA polymerases (SEQ ID NOS: 18 and 19), an ABC transporter-likeprotein (SEQ ID NO: 20), a Kunitz-motif protease inhibitor (KPI) (SEQ ID NO: 21), a poly(A) polymerase large subunit (SEQ ID NO: 22) and other AmEPV polypeptides.

The subject invention further pertains to other entomopoxvirus sequences. Polynucleotides of the subject invention include, for example, sequences identified in the attached sequence listing, as well as the tables and figures and described by open reading frame position within the genome.

In addition, the subject invention includes polynucleotides which hybridize with other polynucleotides of the subject invention.

Polynucleotide sequences of this invention have numerous applications in techniques known to those skilled in the art of molecular biology having the benefit of the instant disclosure. These techniques include their use as insertion sites for foreign genes of interest, hybridization probes, for chromosome and gene mapping, in PCR technologies, and in the production of sense or antisense nucleic acids.

BRIEF DESCRIPTION OF THE DRAWINGS

The file of this patent contains at least one drawing executed in color. Copies of this patent with color drawings(s) will be provided by the Patent and Trademark Office upon request and payment of the necessary fee.

FIGS. 8(A-D) shows a comparison of the genomic organization of AmEPV, MsEPV and VV. AmEPV ITRs are positioned at the termini of the viral genome as indicated. AmEPV genes which have homology to VV genes are depicted in (A). AmEPV genes which have homology to MsEPV are depicted in (B). Genes in the AmEPV genome common to both MsEPV and VV are in (C). Unique genes encoded by AmEPV are shown in (D).

FIG. 10 shows residues shared between poxvirus poly(a) polymerase subunit homologs (SEQ ID NOs. 16, 17, and 75–80). Consensus shows the conservation between all five sequences. Insect consensus shows identity among the four EPV ORFs. AmEPV consensus displays identities between the two AmEPV subunits.

BRIEF DESCRIPTION OF THE SEQUENCE

SEQ ID NO: 1 is the nucleotide sequence of the gene encoding AmEPV triacylglyceride lipase (AMV133).

SEQ ID NO: 2 is the nucleotide sequence of the gene encoding AmEPV $Cu^{++}/Zn^{++}$ superoxide dismutase (SOD) (AMV255).

SEQ ID NO: 3 is the nucleotide sequence of the gene encoding AmEPV CPD photolyase (AMV025).

SEQ ID NO: 4 is the nucleotide sequence of the gene encoding AmEPV baculovirus-like inhibitor of apoptosis (IAP) (AMV021).

SEQ ID NO: 5 is the nucleotide sequence of the gene encoding a first AmEPV poly(A) polymerase small subunit (AMV060).

SEQ ID NO: 6 is the nucleotide sequence of the gene encoding a second AmEPV poly(A) polymerase small subunit (AMV115).

SEQ ID NO: 7 is the nucleotide sequence of the gene encoding a first AmEPV DNA polymerase (AMV050).

SEQ ID NO: 8 is the nucleotide sequence of the gene encoding a second AmEPV DNA polymerase (AMV210).

SEQ ID NO: 9 is the nucleotide sequence of the gene encoding AmEPV ABC transporter-like protein (AMV130).

SEQ ID NO: 10 is the nucleotide sequence of the gene encoding AmEPV Kunitz-motif inhibitor (KPI) (AMV007).

SEQ ID NO: 11 is the nucleotide sequence of the gene encoding AmEPV poly(A) polymerase large subunit (AMV038).

SEQ ID NO: 12 is the amino acid sequence for the AmEPV triacylglyceride lipase (AMV133).

SEQ ID NO: 13 is the amino acid sequence for the AmEPV $Cu^{++}/Zn^{++}$ superoxide dismutase (SOD) (AMV255).

SEQ ID NO: 14 is the amino acid sequence for the AmEPV CPD photolyase (AMV025).

SEQ ID NO: 15 is the amino acid sequence for the AmEPV baculovirus-like inhibitor of apoptosis (IAP) (AMV021).

SEQ ID NO: 16 is the amino acid sequence for the first AmEPV poly(A) polymerase small subunit (AMV060).

SEQ ID NO: 17 is the amino acid sequence for the second AmEPV poly(A) polymerase small subunit (AMV115).

SEQ ID NO: 18 is the amino acid sequence for the first AmEPV DNA polymerase (AMV050).

SEQ ID NO: 19 is the amino acid sequence for the second AmEPV DNA polymerase (AMV210).

SEQ ID NO: 20 is the amino acid sequence for the AmEPV ABC transporter-like protein (AMV130).

Figures 11, 12:
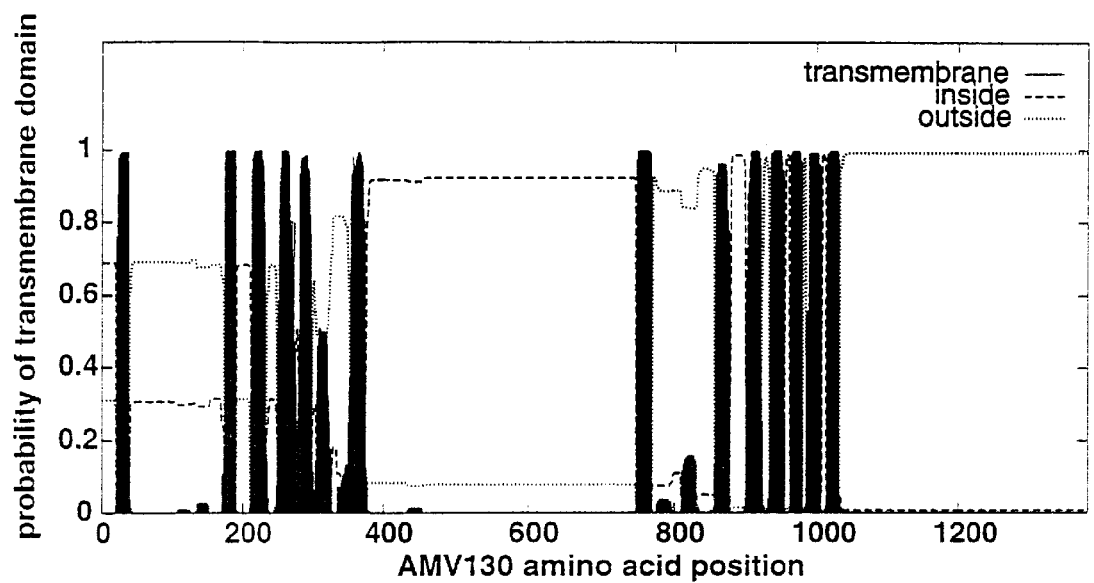
FIG. 11 shows the transmembrane domains possessed by the AmEPV ABC transporter protein. This graphic was produced by the THAMM program (Sonnhammer, E. L. L., Hejne, G., and Krogh, A. [1998] "A hidden Markov model for predicting transmembrane helices inprotein sequences" Proc. of Sixth Int. Conf. on Intelligent Systems for Molecular Biology (J. Glasgow, T. Littlejohn, F. Major, R. Lathrop, D. Sankoff, and C. Sensen, Eds.), pp. 175–182. AAAI press, Menlo Park, Calif.). The regions of the protein indicated by the thirteen bars can be seen to have a probability of 1 as transmembrane domains. Although not shown in this figure, the areas between these domains (residues 432–601 and 1097–1285) contain ABC transporter (ATP binding) motifs (Prosite PS00211).
FIG. 12 shows the amino acid sequence of the AmEPV serine protease inhibitor (SEQ ID NO. 21). Amino acid abbreviations are standard. The Kunitz family signature (Prostite PS00280) is shown underlined and italicized from residues 55 to 73.

SEQ ID NO: 21 is the amino acid sequence for the AmEPV Kunitz-motif inhibitor (KPI) (AMV007) (FIG. 12).

SEQ ID NO: 22 is the amino acid sequence for the AmEPV poly(A) polymerase large subunit (AMV038).

SEQ ID NOS: 23–27 is the nucleotide sequence of the AmEPV genome.

SEQ ID NO: 28 is the nucleotide sequence and amino acid sequence for an AmEPV enhancin protein (AMVITR10).

SEQ ID NO: 29 is the nucleotide sequence and amino acid sequence for an AmEPV dUTPase (AMV002).

SEQ ID NO: 30 is the nucleotide sequence and amino acid sequence for an AmEPV very late transcription factor-2 (VLTF-2) (AMV047).

SEQ ID NO: 31 is the nucleotide sequence and amino acid sequence for a first AmEPV RNA polymerase (AMV051).

SEQ ID NO: 32 is the nucleotide sequence and amino acid sequence for a second AmEPV RNA polymerase (AMV054).

SEQ ID NO: 33 is the nucleotide sequence and amino acid sequence for an AmEPV DNA helicase (AMV059).

SEQ ID NO: 34 is the nucleotide sequence and amino acid sequence for an AmEPV 30K virion protein (AMV061).

SEQ ID NO: 35 is the nucleotide sequence and amino acid sequence for a third AmEPV RNA polymerase (AMV066).

SEQ ID NO: 36 is the nucleotide sequence and amino acid sequence for an AmEPV protein tyrosine phosphatase (AMV078).

SEQ ID NO: 37 is the nucleotide sequence and amino acid sequence for an AmEPV thioredoxin protein (AMV079).

SEQ ID NO: 38 is the nucleotide sequence and amino acid sequence for an AmEPV RNA helicase (AMV081).

SEQ ID NO: 39 is the nucleotide sequence and amino acid sequence for a first AmEPV serine/threonine protein kinase (AMV084).

SEQ ID NO: 40 is the nucleotide sequence and amino acid sequence for an AmEPV NTPase (AMV087).

SEQ ID NO: 41 is the nucleotide sequence and amino acid sequence for an AmEPV transcription factor (AMV091).

SEQ ID NO: 42 is the nucleotide sequence and amino acid sequence for an AmEPV mRNA capping small subunit (AMV093).

SEQ ID NO: 43 is the nucleotide sequence and amino acid sequence for an AmEPV very early transcription factor-large protein (VETF-L) (AMV105).

SEQ ID NO: 44 is the nucleotide sequence and amino acid sequence for an AmEPV redox protein (AMV114).

SEQ ID NO: 45 is the nucleotide sequence and amino acid sequence for an AmEPV rifampicin resistance protein (AMV122).

SEQ ID NO: 46 is the nucleotide sequence and amino acid sequence for an AmEPV mRNA capping large subunit (AMV135).

SEQ ID NO: 47 is the nucleotide sequence and amino acid sequence for an AmEPV P4a core protein (AMV139).

SEQ ID NO: 48 is the nucleotide sequence and amino acid sequence for an AmEPV P4b core protein (AMV147).

SEQ ID NO: 49 is the nucleotide sequence and amino acid sequence for an AmEPV ATP/GTP binding protein (AMV150).

SEQ ID NO: 50 is the nucleotide sequence and amino acid sequence for a second AmEPV serine threonine protein kinase (AMV153).

SEQ ID NO: 51 is the nucleotide sequence and amino acid sequence for a fourth AmEPV RNA polymerase (AMV166).

SEQ ID NO: 52 is the nucleotide sequence and amino acid sequence for an AmEPV polyubiquitin protein (AMV167).

SEQ ID NO: 53 is the nucleotide sequence and amino acid sequence for AmEPV very small transcription factor-short protein (VETF-s) (AMV174).

SEQ ID NO: 54 is the nucleotide sequence and amino acid sequence for AmEPV core protein (AMV181).

SEQ ID NO: 55 is the nucleotide sequence and amino acid sequence for an AmEPV nucleoside triphosphate phosphorylase 1 (NPH I) (AMV192).

SEQ ID NO: 56 is the nucleotide sequence and amino acid sequence for an AmEPV apoptosis-associated protein (AMV193).

SEQ ID NO: 57 is the nucleotide sequence and amino acid sequence for a third AmEPV serine/threonine protein kinase (AMV197).

SEQ ID NO: 58 is the nucleotide sequence and amino acid sequence for an AmEPV NAD+ dependent DNA ligase (AMV199).

SEQ ID NO: 59 is the nucleotide sequence and amino acid sequence for an AmEPV very late transcription factor-3 (VLTF-3) (AMV205).

SEQ ID NO: 60 is the nucleotide sequence and amino acid sequence for a fifth AmEPV RNA polymerase (AMV221).

SEQ ID NO: 61 is the nucleotide sequence and amino acid sequence for an AmEPV $Ca^{2+}$ binding protein (AMV228).

SEQ ID NO: 62 is the nucleotide sequence and amino acid sequence for a sixth AmEPV RNA polymerase (AMV230).

SEQ ID NO: 63 is the nucleotide sequence and amino acid sequence for an AmEPV DNA glycosylase (AMV231).

SEQ ID NO: 64 is the nucleotide sequence and amino acid sequence for an AmEPV protein phosphatase (AMV234).

SEQ ID NO: 65 is the nucleotide sequence and amino acid sequence for an AmEPV phosphotyrosine kinase (AMV246).

SEQ ID NO: 66 is the nucleotide sequence and amino acid sequence for an AmEPV glycosyl transferase (AMV248).

SEQ ID NO: 67 is the nucleotide sequence and amino acid sequence for an AmEPV metalloprotease (AMV256).

SEQ ID NO: 68 is the nucleotide sequence and amino acid sequence for an AmEPV myristylated membrane protein (AMV217).

SEQ ID NO: 69 is the nucleotide sequence and amino acid sequence for an AmEPV NTP pyrophosphohydrolase (AMV058).

SEQ ID NO: 70 is the nucleotide sequence and amino acid sequence for an AmEPV DNA topoisomerase (AMV052).

SEQ ID NO: 71 is the nucleotide sequence and amino acid sequence for a first AmEPV membrane protein (AMV118).

SEQ ID NO: 72 is the nucleotide sequence and amino acid sequence for a second AmEPV membrane protein (AMV232).

SEQ ID NO: 73 is the nucleotide sequence and amino acid sequence for a third AmEPV membrane protein (AMV243).

SEQ ID NO: 74 is the nucleotide sequence and amino acid sequence for a fourth AmEPV membrane protein (AMV035).

Figure 10:
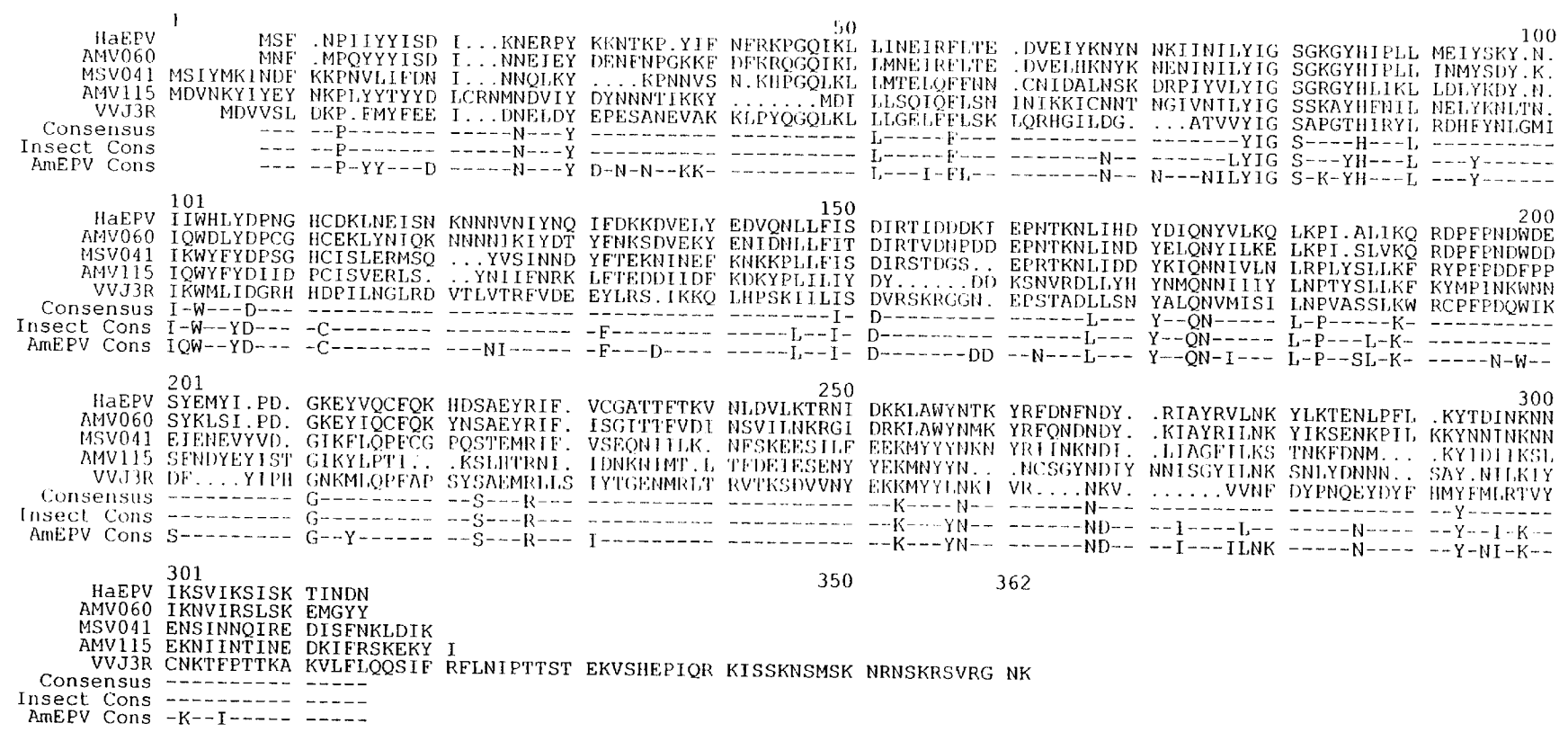

SEQ ID NOs: 75–80 are consensus sequences within poxvirus poly(a) polymerase subunit homologs (FIG. 10).

DETAILED DISCLOSURE OF THE INVENTION

The subject invention concerns three aspects of entomopoxviruses (EPVS) as novel recombinant vectors: (1) As a system for the expression of high levels of foreign proteins. (2) for the transient expression of foreign genes in mammalian cells and (3) for the stable transformation of vertebrate cells for the long term expression of foreign proteins. In addition, the subject invention provides the nucleotide sequence of the entire genome of genus B entomopoxvirus from *Amsacta moorei* (AmEPV). Accordingly, the subject invention also concerns isolated polynucleotides encoding AmEPV proteins.

The subject invention concerns novel recombinant vectors and methods for delivery and expression of heterologous polynucleotides in vertebrate cells. The recombinant vectors of the subject invention provide for stable integration and expression of heterologous DNA in the host cell. Advantageously, the vectors of the invention are adapted for accepting large heterologous polynucleotide inserts which can be delivered in an infected or transformed cell and expressed in a stable fashion. The subject invention can be used to provide gene therapy for conditions or disorders of vertebrate animals, such as a mammal or human, that is in need of such therapy.

One aspect of the subject invention concerns a recombinant EPV vector which can optionally include heterologous DNA which can be expressed in a cell infected or transformed with the subject vector. Preferably, the EPV vector is derived from AmEPV. The recombinant EPV vectors of the present invention can optionally include inverted terminal repeat (ITR) sequences of a virus, such as, for example, adeno-associated virus, that flank the heterologous DNA insertion site on the vector. Thus, when the heterologous DNA is cloned into the recombinant EPV vector, the heterologous DNA is flanked upstream and downstream by the ITR sequences.

In an exemplified embodiment, the subject vectors comprise heterologous DNA inserted within the vector. The heterologous DNA contained within the recombinant vectors of the invention can include polynucleotide sequences which encode a biologically functional protein. Preferably the polynucleotides encode proteins which can provide therapeutic replacement or supplement in animals afflicted with disorders which result in the animal expressing abnormal or deficient levels of the protein that are required for normal biological function. Proteins encoded by the heterologous DNA can include, but are not limited to interleukins, cytokines, growth factors, interferons, enzymes, and structural proteins. Proteins encoded by the heterologous DNA can also include proteins that provide a selectable marker for expression, such as antibiotic resistance in eukaryotes.

In a preferred embodiment, heterologous DNA within the subject vectors is operably linked with and under the control of regulatory sequences, such as promoters. The recombinant vectors of the invention preferably comprises a constitutive or regulatable promoter capable of promoting sufficient levels of expression of the heterologous DNA contained in the viral vector in a vertebrate cell. Promoters useful with the subject vectors include, for example, the cytomegalovirus (CMV) promoters and the herpes TK gene promoter. The vectors can also include other regulatory elements such as introns inserted into the polynucleotide sequence of the vector.

The strategy for generation of recombinant viruses is identical to that used for VV virus and takes advantage of the high levels of recombination with transfected plasmids mediated by these viruses. The basic procedure utilizes transfection of AmEPV-infected cells with an appropriately designed shuttle vector. Insertion of foreign genes occurs within a non-essential gene (e.g., spheroidin or TK). Because of the cytoplasmic nature of AmEPV, it is necessary to place all foreign genes under control of an AmEPV (early or late) poxvirus promoter. Recombinants are selected and subjected to three rounds of plaque purification before use.

The subject invention also concerns cells containing recombinant vectors of the present invention. The cells can be, for example, vertebrate cells such as mammalian cells. Preferably, the cells are human cells. Cell lines infected or transformed with the recombinant vectors of the present invention are also within the scope of the invention.

The recombinant vectors of the present invention can be introduced into suitable cells or cell lines by methods known in the art. If the recombinant vectors are packaged in viral particles then cells or cell lines can be infected with the virus containing the recombinant vector. Methods contemplated for introducing recombinant vector into cells or cell lines also include transfection, transduction and injection. For example, vectors can be introduced into cells using liposomes containing the subject recombinant vectors. Recombinant viral particles and vectors of the present invention can be introduced into cells by in vitro or in vivo means.

Infection of vertebrate cells is non-permissive, in that early but not late AmEPV gene expression occurs (Li, Y., R. L. Hall, R. W. Moyer [1997] "Transient, nonlethal expression of genes in vertebrate cells by recombinant entomopoxviruses" *J. Virol.* 71:9557–9562). Specifically, if a reporter gene, such as lucZ, is driven by a late poxvirus promoter, such as either the AmEPV spheroidin or cowpox virus ATI (A-type Inclusion) promoter, no expression of galactosidase is observed. If, however, the lacZ is driven instead by either of two early EPV promoters (the *Melolontha melolontha* EPV fusolin gene promoter (Gauthier, L., F. Coussrans, J. C. Veyrunes, M. Bergoin [1995] "The *Melolontha melolontha* entomopoxvirus (MmEPV) fusolin is related to the fusolins of lepidoptera EPVs and to the 37 K baculovirus glycoprotein" *Virology* 208:427–436) or the 42 kDa early AmEPV protein (Li et al. [1997] supra), high levels of galactosidase in the recombinant AmEPV infected vertebrate cells are observed. These results provide clear evidence of AmEPV entry into vertebrate cells followed by early, but not late, viral gene expression.

It has also been found that vertebrate cells survive infection by AmEPV. If CV-1 cells are infected with an AmEPV recombinant which contains the green fluorescent protein (GFP) gene regulated by the 42 kDa AmEPV early promoter (also called the esp promoter), single, fluorescent cells are initially observed which then proceed to grow and divide, ultimately forming small clusters of fluorescent cells. Therefore, AmEPV enters vertebrate cells, to produce a non-permissive, abortive infection, early viral genes are expressed and infected cells appear to survive and continue to divide. These properties plus a very large capacity of the virus for foreign genes make AmEPV an excellent-vector for delivery of genes for expression in a transient fashion.

However, in addition to the ability to express foreign genes in a transient fashion, it has been found that AmEPV vectors of the subject invention have the ability to stably transform cells and express genes in a long term fashion as well. The data presented within the Examples (e.g., Example 2) and accompanying Figures (e.g., FIG. 2) confirm that the AmEPV vectors of the subject invention can be used to deliver DNA which subsequently integrates into DNA of the mammalian cell nucleus. The ability of AmEPV to deliver DNA to mammalian cells creates endless opportunity for use of the vector in the stable transformation and engineering of vertebrate cells.

The Examples describe methodology for growth, titration and preparation of recombinant AmEPV, as well as transient expression of AMEPV in vertebrate cells, the use of AmEPV to stably transform mammalian cells, and potential uses of AmEPV vectors.

In addition to entomopoxviruses(EPVs) as novel recombinant vectors, and methods of their use, the subject invention provides the nucleotide sequence of the entire genome of the genus B entomopoxvirus from *Amsacta moorei* (AmEPV). This enhances the value of AmEPV as a sector, and particularly as a gene therapy vector, in a number of ways. For example, specific knowledge of the AmEPV genome facilitates the identification of additional sites which may be used as insertion sites for foreign genes of interest.

In addition, the subject invention concerns novel AmEVP polypeptides and the polynucleotide sequences which encode these polypeptides. The AmEPV polynucleotide sequences of the subject invention include polynucleotides encoding a triacylglyceride lipase (SEQ ID NO: 1), a $Cu^{++}/Zn^{++}$ superoxide dismutase (SOD) (SEQ ID NO: 2), a CPD photolyase (SEQ ID NO: 3), a baculovirus-like inhibitor of apoptosis (IAP) (SEQ ID NO: 4), two poly(A) polymerase small subunits (SEQ ID NOS: 5 and 6), two DNA polymerases (SEQ ID NOS: 7 and 8), an ABC transporter-like protein (SEQ ID NO: 9), a Kunitz-motif protease inhibitor (KPI) (SEQ ID NO: 10), and a poly(A) polymerase large subunit (SEQ ID NO: 11) and other polynucleotides.

In addition, the subject invention concerns isolated AmEPV polypeptides encoded by the polynucleotide sequences of the subject invention, including a triacylglyceride lipase (SEQ ID NO: 12), a $Cu^{++}/Zn^{++}$ superoxide dismutase (SOD) (SEQ ID NO: 13), a CPD photolyase (SEQ ID NO: 14), a baculovirus-like inhibitor of apoptosis (IAP) (SEQ ID NO: 15), two poly(A) polymerase small subunits (SEQ ID NOS: 16 and 17), two DNA polymerases (SEQ ID NOS: 18 and 19), an ABC transporter-like protein (SEQ ID NO: 20), a Kunitz-motif protease inhibitor (KPI)(SEQ ID NO: 21), and a poly (A) polymerase large subunit (SEQ ID NO: 22) and other AmEPV polypeptides.

The subject invention includes other AmEPV sequences as described in Table 1, for example. In addition, the subject invention includes polynucleotides which hybridize with other polynucleotides of the subject invention.

The genome of the genus B entomopoxvirus from *Amsacta moorei* (AmEPV) (SEQ ID NOS: 23–27) was sequenced and found to contain 232,392 bases with 279 unique open reading frames (ORFs) of greater than 60 amino acids. The central core of the viral chromosome is flanked by 9.4 kbp inverted terminal repeats (ITRs), each of which contain 13 ORFs, raising the total number of ORFs within the viral chromosome to 292. Default E (EXPECT) values of <0.01 were used to define homology to sequences in current databases. ORFs lacking homology to other poxvirus genes were shown to comprise 33.6% of the viral genome. Approximately 28.6% of the AmEPV genome (52 AmEPV ORFs) encodes homologues of the mammalian poxvirus co-linear core genes, which are found dispersed throughout the AmEPV chromosome. There is also no significant gene order conservation between AmEPV and the orthopteran genus B poxvirus of *Melanoplus sanguinipes* (MsEPV). Novel AmEPV genes include those encoding an ABC transporter and a Kunitz motif protease inhibitor. The most unusual feature of the AmEPV genome relates to the viral encoded poly(A) polymerase. In all other poxviruses this heterodimeric enzyme consists of a single large and small subunit. However, AmEPV appears to encode one large and two distinct small poly (A) polymerase subunits. AmEPV is one of the few entomopoxviruses which can be grown and manipulated in cell culture.

It is commonly observed in poxvirus genomes that the ORFs situated near the ends of the genome are preferentially transcribed towards the closest termini (Upton C., Macen, J. L., Maranchuk, R. A., Delange, A. M., and McFadden, G. [1988] "Tumorigenic poxviruses: fine analysis of the recombination junctions in malignant rabbit fibroma virus, a recombinant between Shope fibroma virus and myxoma virus" *Virology* 166, 229–239; Upton, C. and McFadden, G. [1986] "DNA sequence homology between the terminal inverted repeals of Shope fibroma virus and an endogenous cellular plasmid species" *Mol. Cell Biol.* 6, 265–276). However, as can been seen in FIG. 8, this is not the case with the ORFs of AmEPV, where no discernable pattern of transcription of genes near the termini can be observed.

Previous estimates placed the A+T content of the AmEPV genome at 81.5% (Langridge, W. H. R. [1983] "Partial Characterization of DNA from Five Entomopoxviruses" *J. Invertebr. Path* 42, 369–375). A recalculation based upon the known sequence has raised this to 82.2%, making AmEPV the most A+T rich poxvirus sequenced to date. In this regard, it is interesting to note that 62% of all encoded amino acids are either Ile, Leu, Phe, Asn or Lys, in descending order of frequency, which are comprised mainly of A+T rich codons. The unusually high A+T content may also be reflected in the large number of translational stop codons (8.9% of coding capacity) and relatively few methionine encoding triplets (1.6%).

Table 1 lists all the ORFs encoded by the AmEPV genome, and functions assigned to the encoded proteins. Default E (EXPECT) values of <0.01 were used to define homology to sequences in current databases. 52 AmEPV ORFs (28.6% of the genome) show homology to ChPV genes, and 91 ORFs (31.3% of the genome) have homologs in EPVs or other insect viruses. The terminal regions of AmEPV contain few genes homologous to any other gene.

FIG. 8 illustrates this phenomenon, as well as the observation that AmEPV homologs of both vaccinia and MsEPV genes (which we have used as available examples for the ChPV and EPV) are positioned more towards the centre of the AmEPV genome. In contrast, novel AmEPV genes are easily identified as occurring more often towards the genomic termini.

TABLE 1

Predicted ORFs of the AmEPV genome.

| ORF | position | Ba[a] | | Highest blast hit[b] | Expect(E)[c] | aa | Domains[d] | U | E | C[e] | Promoter[f] |
|---|---|---|---|---|---|---|---|---|---|---|---|
| AMVITR1 | 500-1879 | 460 | AF063866 | MSV010 Leu rich gene family protein | 9.00E−35 | 611 | multiple LRR | x | | | E |
| AMVITR2 | 2108-1929 | 60 | | | | | TM | x | | | E? |
| AMVITR3 | 2273-2542 | 90 | | | | | | x | | | L |
| AMVITR4 | 2934-2545 | 130 | | | | | SP | x | | | E |
| AMVITR5 | 3786-2974 | 271 | | | | | TM | x | | | E |
| AMVITR6 | 3871-4413 | 181 | | | | | | x | | | E |
| AMVITR7 | 4872-4600 | 91 | | | | | | x | | | E |
| AMVITR8 | 6939-5386 | 518 | | | | | TM | x | | | E?,L? |
| AMVITR9 | 7018-7221 | 68 | | | | | Zinc finger | x | | | E |
| AMVITR10 | 7248-7745 | 166 | P29998 | TnGV Enhancin | 0.002 | 901 | TM | x | | | L |
| AMVITR11 | 7783-8160 | 126 | | | | | TM | x | | | L? |
| AMVITR12 | 8737-8180 | 186 | Z98547 | Pf HexExon | 4.00E−04 | 1711 | TM | x | | | E |
| | | | X62089 | C. botulinum BONT/E | 0.001 | 1251 | | | | | |
| AMVITR13 | 8992-8801 | 64 | | | | | TM | x | | | L? |
| AMV001 | 9826-10065 | 80 | | | | | | x | | | E |
| AMV002 | 10272-10700 | 143 | AF160916 | BcDNA LD08534 (D. melan-dUTPase) | 2.00E−45 | 188 | dUTPase | x | | | E?,L? |
| AMV003 | 13194-10750 | 815 | AF081810 | LdOrf-129 LdNPV | 4.00E−39 | 884 | SP, TM | x | | | E?,L? |
| AMV004 | 14087-13278 | 270 | | | | | | x | | | E.L |
| AMV005 | 15230-14181 | 350 | AF063866 | MSV011 Leu rich gene family protein | 3.00E−25 | 505 | multiple LRR | | x | | E.L? |
| AMV006 | 15229-15624 | 132 | | | | | | x | | | E?,L? |
| AMV007 | 15877-15641 | 79 | Z73971 | C elegans MEC-9L protein | 7.00E−05 | 838 | Kunitz BPTI, SP | x | | | E |
| AMV008 | 16235-15939 | 99 | | | | | | x | | | L? |
| AMV009 | 16090-16452 | 121 | | | | | TM | x | | | L? |
| AMV010 | 17090-16275 | 272 | | | | | | x | | | E |
| AMV011 | 17535-17083 | 151 | | | | | | x | | | E |
| AMV012 | 17288-17545 | 86 | | | | | TM | x | | | |
| AMV013 | 18170-17571 | 200 | | | | | | x | | | E |
| AMV014 | 19693-18236 | 486 | AF063866 | MSV240 Leu rich repeat | 6.00E−22 | 527 | | | x | | E |
| AMV015 | 18363-18814 | 84 | | | | | TM | x | | | L? |
| AMV016 | 19763-20308 | 182 | Q05880 | CfEPV Thymidine Kinase (J2R) | 5.00E−64 | 185 | TK | x | x | | E |
| AMV017 | 20327-20524 | 66 | P28853 | hyp region in Q1 ORF-frameshift? | 1.00E−06 | 66 | Leu zipper | x | | | L |
| AMV018 | 20836-20525 | 104 | | | | | | x | | | E |
| AMV019 | 22494-20923 | 524 | AF162221 | XcGV ORF67 | 6.00E−73 | 568 | | x | | | E |
| AMV020 | 22555-23754 | 400 | | | | | | x | | | L |
| AMV021 | 24548-23757 | 264 | P41436 | CpGV IAP | 5.00E−80 | 275 | 2 BIR | x | | | E |
| AMV022 | 25187-24612 | 192 | | | | | | x | | | L? |
| AMV023 | 25296-25700 | 135 | | | | | | x | | | E |
| AMV024 | 25919-26980 | 354 | AF017791 | HaEPV 17K orf | 3.00E−28 | 148 | | | x | | E?,L? |
| | | | AF022176 | HaEPV orf6 | 2.00E−10 | 286 | | | | | |
| AMV025 | 26995-28353 | 453 | AF063866 | MSV235 CPD photolyase | 6.00E−91 | 468 | photolyase | | x | x | L? |
| AMV026 | 28719-28369 | 117 | | | | | | x | | | E |
| AMV027 | 29077-28775 | 101 | | | | | | x | | | E |
| AMV028 | 29608-29144 | 155 | | | | | | x | | | E |
| AMV029 | 30545-29676 | 290 | AF063866 | MSV027 Trp repeat gene family protein | 4.00E−50 | 297 | | | x | | E |
| AMV030 | 31173-30742 | 144 | | | | | | x | | | E |
| AMV031 | 31640-32092 | 151 | | | | | TM | x | | | E |
| AMV032 | 32570-32100 | 157 | U30297 | (AmEPV FALPE) | | | | x | | | L |
| AMV033 | 32689-33975 | 429 | AF063866 | MSV019 hp | 3.00E−25 | 437 | | | x | | L |
| AMV034 | 34365-33976 | 130 | AF019224 | HaEPV F4L | 4.00E−08 | 85 | | | x | | E |
| AMV035 | 34428-35435 | 336 | AF063866 | MSV121 membrane protein (G9R) | 3.00E−86 | 333 | | | x | x | L? |
| AMV036 | 35313-35104 | 70 | | | | | | x | | | L? |
| AMV037 | 36182-35442 | 247 | X95275 | Pf frameshift | 2.00E−04 | 960 | | x | | | L |
| AMV038 | 37923-36205 | 573 | AF063866 | MSV143 PAP-L (E1L) | 1.00E−125 | 571 | | | x | x | L? |
| AMV039 | 38018-39613 | 532 | | | | | | x | | | L? |
| AMV040 | 40159-39608 | 184 | AF063866 | MSV138 hp | 0.002 | 190 | | x | | | L |

TABLE 1-continued

Predicted ORFs of the AmEPV genome.

| ORF | position | Ba[a] | Highest blast hit[b] | Expect(E)[c] | aa | Domains[d] | U | E | C[e] | Promoter[f] |
|---|---|---|---|---|---|---|---|---|---|---|
| AMV041 | 40203-40841 | 213 | AF063866 MSV039 (G6R) | 1.00E−43 | 193 | | | x | x | L |
| AMV042 | 40858-41205 | 116 | | | | | x | | | L? |
| AMV043 | 41228-41428 | 67 | AF063866 MSV188 hp | 3.00E−07 | 68 | | | x | | E.L |
| AMV044 | 43176-41431 | 582 | AF063866 MSV140 hp | 3.00E−17 | 808 | TM | | x | | L |
| AMV045 | 45167-43206 | 654 | AF063866 MSV077 hp | 1.00E−15 | 598 | TM | | x | | E |
| AMV046 | 43777-43962 | 62 | | | | TM | x | | | E? |
| AMV047 | 45255-46031 | 259 | AF063866 MSV187 VLTF-2 (A1L) | 5.00E−41 | 261 | | | x | x | L |
| AMV048 | 47092-46034 | 353 | AF063866 MSV156 hp | 8.00E−06 | 1127 | | | x | | L? |
| AMV049 | 47212-47772 | 187 | | | | | x | | | L? |
| AMV050 | 51077-47763 | 1105 | X57314 CbEPV DNA polymerase (E9L) [36] | * | 964 | DNA pol B | | x | x | E |
| AMV051 | 52177-51131 | 349 | AF063866 MSV149 RPO35 (A29L) | 8.00E−54 | 348 | | | x | x | E |
| AMV052 | 52298-53296 | 333 | AF063866 MSV130 DNA topoisomerase (H6R) | 1.00E−106 | 328 | TM | | x | x | L |
| AMV053 | 54234-53299 | 312 | AF063866 MSV120 hp | 4.00E−10 | 251 | | | x | | E |
| AMV054 | 54298-56763 | 822 | AF063886 MSV119 RAP94 (H4L) | 1.00E−150 | 807 | TM | | x | x | L |
| AMV055 | 57258-56860 | 133 | AF022176 HaEPV orf6 | 2.00E−14 | 286 | | | x | | E |
|  |  |  | AF063866 MSV194 ALI motif | 1.00E−10 | 409 | | | | | |
| AMV056 | 57332-57589 | 86 | | | | TM | x | | | |
| AMV057 | 58350-57292 | 353 | AF022176 HaEPV orf6 | 4.00E−90 | 288 | | | x | | E |
|  |  |  | AF063866 MSV194 ALI motif | 8.00E−14 | 409 | | | | | |
| AMV058 | 58496-59323 | 276 | AF063866 MSV150 NTP pyrophosphohydor-lase/mutT (D10R) | 1.00E−18 | 289 | MutT | | x | x | E |
| AMV059 | 59361-60761 | 469 | AF063866 MSV148 DNA helicase (A18R) | 5.00E−78 | 471 | DEAD box/helicase C | | x | x | L? |
| AMV060 | 60806-61690 | 295 | HaEPV PAP reg subunit (J3R) [41] | 1.00E−102 | 293 | PARP reg | | x | x | E? L? |
| AMV061 | 62470-61706 | 255 | AF022176 HaEPV 30K vinon protein (L4R) [158] | 4.00E−92 | 293 | | | x | | L |
| AMV062 | 62518-63009 | 164 | AF022176 HaEPV orf4 [160] | 1.00E−61 | 166 | | | x | | E?L? |
| AMV063 | 63072-63686 | 205 | | | | | x | | | L? |
| AMV064 | 64223-63696 | 176 | | | | | x | | | E |
| AMV065 | 63919-64113 | 65 | | | | TM | x | | | L? |
| AMV066 | 64284-67871 | 1196 | AF063866 MSV155 RNApol RPO132 (A24R) | * | 1190 | | | x | x | L |
| AMV067 | 65029-64847 | 61 | | | | | x | | | |
| AMV068 | 68446-67892 | 185 | | | | TM | x | | | E |
| AMV069 | 69546-68505 | 348 | AF063866 MSV180 (L3L) | 8.00E−59 | 343 | | | x | x | L |
| AMV070 | 69602-70357 | 252 | | | | | x | | | E |
| AMV071 | 70684-70358 | 109 | AF063866 MSV049 hp | 2.00E−17 | 116 | TM | | x | | L? |
| AMV072 | 70698-71168 | 157 | AF063866 MSV044 hp | 3.00E−20 | 165 | | | x | | L |
| AMV073 | 71234-71485 | 84 | | | | | x | | | L? |
| AMV074 | 71866-71549 | 106 | | | | SP, TM | x | | | L? |
| AMV075 | 71613-72066 | 158 | | | | | x | | | E |
| AMV076 | 72586-72236 | 117 | AF063866 MSV255 Leu rich gene family protein | 1.00E−09 | 403 | | | x | | L? |
| AMV077 | 72369-72629 | 87 | | | | TM | x | | | |
| AMV078 | 73085-73579 | 165 | AF108690 SeNPV protein-Tyr phosphatase | 6.00E−25 | 165 | DSPc | x | | x | L |
| AMV079 | 73874-73688 | 69 | AF063866 MSV087 Thioredoxin | 1.00E−08 | 76 | | | x | | L |
| AMV080 | 74247-73870 | 126 | AF063866 MSV085 hp | 1.00E−04 | 118 | TM, Leu zipper | | x | | E.L |
| AMV081 | 76410-74251 | 720 | AF063866 MSV086 RNA helicase (tBR) | 1.00E−172 | 717 | DEAD box/helicase C | | x | | L? |
| AMV082 | 76620-76435 | 82 | | | | | x | | | L? |
| AMV083 | 76827-77028 | 134 | | | | TM | x | | | L |
| AMV084 | 77056-77865 | 270 | U87984 D. melan. ovarian spec. Ser/Thr kinase | 2.00E−13 | 459 | 2 pkinase | x | | | E |
| AMV085 | 77906-78517 | 204 | AF063866 MSV088 hp | 2.00E−14 | 205 | | | x | | L |
| AMV086 | 79422-79138 | 95 | | | | | x | | | E |
| AMV087 | 81627-79450 | 726 | AF083866 MSV089 NTPase (D5R) | 1.00E−139 | 834 | | | x | | E |
| AMV088 | 81771-82097 | 109 | | | | | x | | | L |
| AMV089 | 82126-82437 | 104 | | | | TM | x | | | L |
| AMV090 | 83288-82440 | 263 | AF083868 MSV116 hp | 3.00E−08 | 317 | | | x | | E |
| AMV091 | 84321-83254 | 356 | AF063866 MSV052 (A23R) | 3.00E−38 | 345 | | | x | | E |
| AMV092 | 83537-83842 | 102 | | | | TM | x | | | L? |
| AMV093 | 85132-84347 | 262 | AF063866 MSV124 mRNA capping small subunit (D12L) | 3.00E−53 | 267 | | | x | x | E?.L |
| AMV094 | 86177-85998 | 60 | | | | | x | | | L? |
| AMV095 | 86119-86310 | 64 | | | | TM | x | | | |
| AMV096 | 87404-86394 | 337 | AF063866 MSV213 hp | 6.00E−86 | 331 | | | x | | L |
| AMV097 | 87220-87405 | 62 | | | | | x | | | E |
| AMV098 | 87478-87903 | 142 | AF063866 MSV136 hp | 5.00E−12 | 150 | | | x | | L |
| AMV099 | 89237-87918 | 440 | AF063866 MSV071 hp | 7.00E−32 | 442 | | | x | | L? |
| AMV100 | 89670-89263 | 136 | AF017791 HaEPV 17K ORF | 5.00E−05 | 148 | | | x | | E,L |
| AMV101 | 90120-69695 | 142 | AF063866 MSV079 hp with C2H2 zinc finger | 1.00E−19 | 138 | | | x | | E,L |
| AMV102 | 90585-90142 | 148 | AF063866 MSV092 hp | 2.00E−12 | 196 | | | x | | E?,L? |

TABLE 1-continued

Predicted ORFs of the AmEPV genome.

| ORF | position | Ba[a] | Highest blast hit[b] | Expect(E)[c] | aa | Domains[d] | U | E | C[e] | Promoter[f] |
|---|---|---|---|---|---|---|---|---|---|---|
| AMV103 | 90272-90475 | 68 | | | | | x | | | L? |
| AMV104 | 91030-90572 | 153 | | | | | x | | | E |
| AMV105 | 91081-93381 | 767 | AF063866 MSV063 VETF-L (A7L) | * | 760 | | | x | x | E,L |
| AMV106 | 93290-92931 | 120 | | | | TM | x | | | E?,L? |
| AMV107 | 93837-93391 | 149 | | | | | x | | | E |
| AMV108 | 93494-93736 | 81 | | | | TM | x | | | E?,L? |
| AMV109 | 93941-95290 | 450 | AF162221 XcGV ORF22 | 6.00E-76 | 492 | | x | | | E |
| AMV110 | 95332-96417 | 362 | AF017791 HaEPV 17K ORF | 5.00E-28 | 148 | | | x | | E |
| AMV111 | 95942-95700 | 81 | | | | TM | x | | | L? |
| AMV112 | 96452-97495 | 348 | AF017791 HaEPV 17K ORF | 3.00E-30 | 148 | | | x | | E? |
| AMV113 | 97020-96820 | 67 | | | | SP, TM | x | | | L? |
| AMV114 | 97527-97841 | 105 | AF063866 MSV093 put. redox (E10R) | 2.00E-27 | 107 | SP | | x | x | L |
| AMV115 | 97853-98731 | 293 | AF063866 MSV041 PAP-S (J3R) | 1.00E-27 | 295 | PARP reg | | x | x | L? |
| AMV116 | 99126-98734 | 131 | | | | | x | | | L? |
| AMV117 | 99484-99131 | 118 | | | | | x | | | L? |
| AMV118 | 100672-99515 | 386 | AF063866 MSV090 put. membrane protein (A16L) | 1.00E-121 | 380 | TM | | x | x | L |
| AMV119 | 102089-101016 | 358 | AF063866 MSV081 PP2C | 4.00E-69 | 357 | PP2C | | x | | L |
| AMV120 | 102151-102570 | 140 | AF063866 MSV082 hp | 2.00E-08 | 139 | | | x | | L |
| AMV121 | 103396-102581 | 272 | AF063866 MSV064 hp | 2.00E-31 | 280 | | | x | | E?,L? |
| AMV122 | 105388-103688 | 567 | U44841 HaEPV rifampicin resistance gene (D13L) [69] | * | 584 | | | x | x | E? |
| AMV123 | 105901-105470 | 144 | | | | TM | x | | | E |
| AMV124 | 107828-105948 | 627 | | | | TM | x | | | L |
| AMV125 | 107560-107739 | 60 | | | | TM | x | | | L? |
| AMV126 | 108199-107915 | 95 | | | | | x | | | E |
| AMV127 | 109346-108762 | 195 | AF063866 MSV060 (H2R) | 1.00E-57 | 194 | TM | | x | x | L |
| AMV128 | 110119-109364 | 252 | | | | TM | x | | | E |
| AMV129 | 110338-110156 | 61 | | | | | x | | | E?,L? |
| AMV130 | 110459-114610 | 1384 | ZB2272 C. elegans similar to ABC transporters | 5e-54** | 1431 | TM | x | | | E |
| AMV131 | 115711-114941 | 257 | | | | | x | | | E |
| AMV132 | 116352-115732 | 207 | AF017791 HaEPV 17K ORF | 0.001 | 148 | | | x | | E |
| AMV133 | 117243-116383 | 287 | AF063866 MSV048 lipase | 1.00E-56 | 288 | lipase 3 TM | | x | x | L |
| AMV134 | 118889-117285 | 535 | AF063866 MSV240 Leu rich repeat (AmEPV Q3) | 5.00E-15 | 527 | | | x | | E |
| AMV135 | 121563-118948 | 872 | AF063866 MSV067 put mRNA capping large subunit (D1R) | * | 860 | | | x | x | E |
| AMV136 | 120638-120928 | 97 | | | | TM | x | | | E |
| AMV137 | 121578-122222 | 215 | AF063866 MSV068 hp | 2.00E-15 | 160 | TM | | x | | L |
| AMV138 | 123184-122225 | 320 | AF063866 MSV151 (A11R) | 5.00E-29 | 313 | | | x | x | L |
| AMV139 | 123209-126655 | 1149 | AF063866 MSV152 P4a (A10L) | 1e-63/6e-29 | 1306 | | | x | x | L |
| AMV140 | 127596-126687 | 310 | AF063866 MSV170 hp | 3.00E-07 | 324 | | | x | | E |
| AMV141 | 127730-129085 | 452 | AF063866 MSV050 hp | 5.00E-57 | 379 | TM | | x | | L? |
| AMV142 | 128757-128554 | 68 | | | | TM | x | | | L? |
| AMV143 | 129503-129061 | 141 | | | | TM | x | | | L? |
| AMV144 | 129837-129493 | 115 | | | | TM | x | | | E |
| AMV145 | 130422-129880 | 181 | AF063866 MSV167 hp | 2.00E-15 | 178 | | | x | | E,L |
| AMV146 | 128909-130115 | 69 | | | | SP | x | | | L? |
| AMV147 | 130483-132486 | 668 | AF063866 MSV164 core protein (A3L) | 1.00E-146 | 648 | TM | | x | x | L |
| AMV148 | 132955-132489 | 156 | | | | TM | x | | | E |
| AMV149 | 133439-133008 | 144 | | | | TM | x | | | E |
| AMV150 | 134239-133520 | 240 | AF063866 MSV171 ATP/GTP binding protein (A23L) | 1.00E-43 | 244 | | | x | x | L? |
| AMV151 | 134280-134930 | 217 | AF063866 MSV172 hp | 0.77 | 184 | | | x | | L |
| AMV152 | 134554-134778 | 75 | | | | TM | | x | | E |
| AMV153 | 134987-136390 | 468 | AF063866 MSV173 Ser/Thr protein kinase (F10L) | 4.00E-73 | 457 | TM | | x | x | E,L |
| AMV154 | 135283-135086 | 66 | | | | | x | | | L? |
| AMV155 | 136164-135970 | 65 | | | | TM | x | | | L? |
| AMV156 | 140090-136377 | 1238 | AF063866 MSV156 hp | 3.00E-28 | 1127 | | | x | | E?,L? |
| AMV157 | 140145-140876 | 244 | AF063866 MSV169 hp | 9.00E-12 | 230 | TM | | x | | L? |
| AMV158 | 140599-140254 | 116 | | | | TM | x | | | L? |
| AMV159 | 141543-140890 | 218 | AF063866 MSV111 hp | 0.001 | 201 | TM | | x | | L? |
| AMV160 | 142175-141549 | 209 | AF063866 MSV110 hp | 0.16 | 181 | TM | | x | | E |
| AMV161 | 142449-142207 | 81 | AF063866 MSV108 hp | 1.00E-11 | 76 | TM | | x | | L |
| AMV162 | 142949-142461 | 163 | AF063866 MSV106 (A22R) | 3.00E-26 | 163 | | | x | x | L? |
| AMV163 | 143230-142955 | 92 | AF063866 MSV112 hp | 0.042 | 130 | TM | | x | | E |
| AMV164 | 143963-143256 | 236 | AF063866 MSV107 hp | 1.00E-26 | 226 | TM | | x | | L |
| AMV165 | 145086-144112 | 325 | | | | TM | x | | | E |
| AMV166 | 145849-145139 | 237 | AF063866 MSV100 RPO19 (A5R) | 1.00E-35 | 230 | | | x | x | E,L |
| AMV167 | 146277-146035 | 81 | U16956 F. neoformas polyubiqurtin [144] | 1.00E-34 | 381 | ubiqurtin | | x | | E |
| AMV168 | 148669-146316 | 118 | AF063866 MSV165 hp | 1.00E-04 | 126 | TM | | x | | E?,L |

TABLE 1-continued

Predicted ORFs of the AmEPV genome.

| ORF | position | Ba[a] | Highest blast hit[b] | Expect(E)[c] | aa | Domains[d] | U | E | C[e] | Promoter[f] |
|---|---|---|---|---|---|---|---|---|---|---|
| AMV169 | 146862-147086 | 75 | | | | TM | x | | | L |
| AMV170 | 147105-148697 | 531 AF063866 | MSV145 hp | 3.00E−83 | 525 | | | x | | L |
| AMV171 | 148735-149010 | 92 AF063866 | MSV166 hp | 4.00E−24 | 96 | TM | | x | | L |
| AMV172 | 149358-149017 | 114 AF063866 | MSV098 hp | 6.00E−04 | 108 | | | x | | L |
| AMV173 | 149405-150724 | 440 AF063866 | MSV157 hp | 9.00E−20 | 430 | | | x | | E |
| AMV174 | 152725-150716 | 670 AF063866 | MSV113 VETF-3 (D6R) | * | 674 | SNF2N/ helicase C, TM | | x | x | E |
| AMV175 | 153799-152762 | 346 AF022176 AF063866 | HaEPV orf5 MSV194 ALI motif | 2.00E−75 3.00E−14 | 286 409 | | | x | | E |
| AMV176 | 152802-153059 | 86 | | | | TM, SP | x | | | |
| AMV177 | 154912-153833 | 360 AF022176 AF063866 | HaEPV orf6 MSV194 ALI motif | 6.00E−73 6.00E−11 | 286 409 | | | x | | E |
| AMV178 | 153873-154130 | 86 | | | | TM, SP | x | | | |
| AMV179 | 154996-156243 | 416 AF063866 | MSV115 (G5R) | 3.00E−29 | 505 | | | x | x | E |
| AMV180 | 156293-156784 | 164 | | | | | x | | | E |
| AMV181 | 158275-156884 | 464 Af063866 | MSV189 core protein [G1L] (I7L) | 1.00E−112 | 443 | | | x | x | L? |
| AMV182 | 157358-157552 | 65 | | | | | x | | | L? |
| AMV183 | 158290-158964 | 225 AF063866 | MSV190 (AmEPV G2R) | 5.00E−09 | 227 | SP | | x | | L |
| AMV184 | 158990-158745 | 82 | | | | TM | x | | | L? |
| AMV185 | 159291-159058 | 78 M77182 | (AmEPV G3L) | 2.00E−35 | 78 | | x | | | E |
| AMV186 | 159318-159800 | 161 AF063866 | MSV132 (A28L) | 2.00E−45 | 142 | TM | | x | x | L? |
| AMV187 | 159896-162904 | 1003 U19239 | CfEPV spheroidin [76] | * | 999 | TM, Leu zipper | | x | | L |
| AMV188 | 161562-161383 | 60 | | | | TM | x | | | |
| AMV189 | 162575-162396 | 60 | | | | | x | | | |
| AMV190 | 162767-162585 | 61 | | | | | x | | | L? |
| AMV191 | 162621-162848 | 76 | | | | TM | x | | | E? |
| AMV192 | 165039-163096 | 648 AF027657 | CfEPV NPH-I (D11L) [53] | * | 647 | SNF2N/ helicase C | | x | x | L |
| AMV193 | 165514-165065 | 150 U83981 | H. sapiens apoptosis-associated protein | 4.00E−04 | 874 | | x | | | L? |
| AMV194 | 165666-167081 | 472 AF063866 | MSV198 MTG motif gene family protein | 7.00E−46 | 399 | | | x | | E |
| AMV195 | 169144-167255 | 630 AE001415 | Pf hp | 1.00E−04 | 1351 | TM | x | | | L |
| AMV196 | 168955-169134 | 60 | | | | TM | x | | | L? |
| AMV197 | 169246-170142 | 299 AF170726 | Myxoma virus m142R (B1R) (154) | 1.00E−27 | 306 | 2 pkinase | | x | x | E |
| AMV198 | 171035-170724 | 104 AF019224 | HaEPV ORF F2L [161] | 1.00E−21 | 101 | TM | | x | | L |
| AMV199 | 171052-172647 | 532 AF063866 | MSV162 NAD-dep DNA ligase | 1.00E−100 | 522 | DNA ligase N | | x | | L? |
| AMV200 | 172798-173481 | 228 AF063866 | MSV159 hp | 4.00E−18 | 225 | | | x | | L |
| AMV201 | 173525-173881 | 119 | | | | TM | x | | | E |
| AMV202 | 173835-173617 | 73 | | | | TM | x | | | L? |
| AMV203 | 174115-173888 | 76 AF063866 | MSV168 hp | 5.00E−06 | 72 | | | x | | L |
| AMV204 | 174147-174395 | 83 | | | | TM | x | | | L |
| AMV205 | 175077-174394 | 228 AF063866 | MSV065 VLTF-3 (A2L) | 1.00E−47 | 218 | | | x | x | L |
| AMV206 | 175140-175601 | 154 | | | | | x | | | E |
| AMV207 | 177028-175601 | 476 AF063866 | MSV198 MTG motif gene family protein | 6.00E−87 | 399 | TM | | x | | L? |
| AMV208 | 176467-176670 | 68 | | | | TM | x | | | |
| AMV209 | 178433-177045 | 463 AF063866 | MSV198 MTG motif gene family protein | 5.00E−97 | 399 | TM | | x | | E? |
| AMV210 | 180326-178491 | 612 AF063866 | MSV117 DNA pol beta/AP polymerase | 1.00E−122 | 603 | AP endo 2/ DNA pol X | | x | | L? |
| AMV211 | 180741-180322 | 140 AF063866 | MSV137 hp | 3.00E−19 | 149 | | | x | | L |
| AMV212 | 181674-180823 | 284 M24328 | Pf Asp-rich protein [261] | 1.00E−05 | 537 | | | x | | E |
| AMV213 | 181926-181720 | 69 | | | | | x | | | E |
| AMV214 | 183172-181961 | 404 AF063866 | MSV184 hp | 8.00E−54 | 415 | TM | | x | | E |
| AMV215 | 182265-182546 | 94 | | | | TM | x | | | L? |
| AMV216 | 184838-183216 | 541 AF063866 | MSV099 hp | 1.00E−41 | 519 | TM | | x | | E |
| AMV217 | 184913-185650 | 246 AF063866 | MSV183 myristylated membrane protein (L1R) | 5.00E−72 | 242 | TM | | x | x | L? |
| AMV218 | 185690-185968 | 93 L27838 | P yoelii rhoptry protein | 0.006 | 2269 | | | x | | E |
| AMV219 | 186862-185966 | 299 AF063866 | MSV072 hp | 1.00E−45 | 298 | | | x | | L |
| AMV220 | 187176-186958 | 73 | | | | TM | x | | | |
| AMV221 | 187007-190909 | 1301 AF063866 | MSV043 RPO147 (J6R) | * | 1319 | RNA pol A | | x | x | E |
| AMV222 | 190095-189904 | 64 | | | | TM | x | | | L? |
| AMV223 | 190945-191358 | 138 | | | | TM | | x | | E |
| AMV224 | 192158-191589 | 190 AE001145 | B. burgdorferi pred. coding region BB0398 | 0.001 | 343 | | | x | | L? |
| AMV225 | 192699-193253 | 185 | | | | | x | | | L? |
| AMV226 | 193743-193252 | 164 AF063866 | MSV031 hp | 7.00e−15** | 141 | | | x | | L |
| AMV227 | 193457-193714 | 86 | | | | TM | x | | | L? |
| AMV228 | 194218-193739 | 160 AF063866 | MSV097 put Ca2 + BP | 5.00E−15 | 140 | 2 EFhand | | x | | E? |
| AMV229 | 194453-194229 | 75 | | | | | x | | | E? |
| AMV230 | 194544-195080 | 179 AF063866 | MSV245 RPO18 (D7R) | 3.00E−20 | 186 | | | x | x | E,L |

TABLE 1-continued

Predicted ORFs of the AmEPV genome.

| ORF | position | Ba[a] | Highest blast hit[b] | | Expect(E)[c] | aa | Domains[d] | U | E | C[e] | Promoter[f] |
|---|---|---|---|---|---|---|---|---|---|---|---|
| AMV231 | 195253-195984 | 244 | AF063866 | MSV208 uracil DNA glycosylase (D4R) | 3.00E−38 | 232 | 2 UNG | | x | x | E |
| AMV232 | 198415-195996 | 140 | AF063866 | MSV142 put. membrane protein (J5L) | 3.00E−36 | 139 | TM | | x | x | L |
| AMV233 | 196480-197103 | 208 | AF063866 | MSV032 hp | 4.00E−20 | 252 | | | x | | L |
| AMV234 | 197134-197844 | 237 | AF063866 | MSV135 put. protein phosphatase 2C | 3.00E−27 | 239 | PP2C | | x | | E?,L |
| AMV235 | 197847-198521 | 225 | AF063866 | MSV123 hp | 1.00E−24 | 230 | | | x | | L? |
| AMV236 | 199146-198517 | 210 | | | | | | x | | | E |
| AMV237 | 199209-199445 | 79 | | | | | | x | | | L |
| AMV238 | 199452-200795 | 448 | AF063866 | MSV055 hp | 7.00E−09 | 466 | TM | | x | | E,L |
| AMV239 | 200248-198973 | 92 | | | | | TM | x | | | L? |
| AMV240 | 201591-200794 | 266 | U42580 | Paramecium bursaria chlorella virus A467L | 8.00E−07 | 312 | | | x | | E?,L |
| AMV241 | 201853-201638 | 72 | | | | | | x | | | L |
| AMV242 | 201954-202283 | 110 | | | | | | x | | | E |
| AMV243 | 203059-202316 | 248 | AF063866 | MSV094 put. membrane protein (F9L) | 7.00E−35 | 241 | TM | | x | x | L? |
| AMV244 | 202716-203075 | 120 | | | | | TM | x | | | |
| AMV245 | 203101-203577 | 159 | | | | | | | x | | E |
| AMV246 | 204042-203572 | 157 | L33180 | AcNPV phosphotyrosine phosphatase | 5.00E−28 | 168 | DSPc | x | | | E |
| AMV247 | 204194-204610 | 139 | AF063866 | MSV139 hp | 1.00E−07 | 139 | | | x | | L |
| AMV248 | 204830-205696 | 289 | AF063866 | MSV206 put. glycosyttranferase | 1.00E−42 | 287 | TM | | x | | L? |
| AMV249 | 205711-206046 | 112 | AF063866 | MSV209 (A21L) | 2.00E−24 | 113 | TM | | x | x | L |
| AMV250 | 206114-206419 | 102 | | | | | | x | | | E |
| AMV251 | 206367-206155 | 71 | | | | | SP | x | | | E |
| AMV252 | 206716-206474 | 81 | | | | | TM | x | | | L? |
| AMV253 | 206768-208222 | 485 | X95275 | Pf frameshift | 6.00E−04 | 960 | | x | | | E |
| AMV254 | 298261-208905 | 215 | AF063866 | MSV027 Trp gene family protein | 1.00E−19 | 297 | | | x | | E |
| AMV255 | 208973-209428 | 152 | P24705 | AcNPV superoxide dismutase | 1.00E−47 | 151 | SODCu | x | | x | L? |
| AMV256 | 211257-209431 | 609 | AF063866 | MSV056 metalloprotease (G1L) | 4.00E−05 | 629 | TM | | x | x | L |
| AMV257 | 211349-211723 | 125 | AF003534 | Chilo indescent virus O11L [196] | 2.00E−14 | 230 | | | x | | L? |
| AMV258 | 211785-214262 | 826 | X95275 | Pf frameshift | 9.00E−04 | 960 | TM | x | | | E? |
| AMV259 | 214913-214488 | 142 | | | | | | x | | | E |
| AMV260 | 216480-214969 | 504 | X95275 | Pf frameshift | 3.00E−12 | 960 | | x | | | E |
| AMV261 | 216586-217788 | 401 | | | | | TM | x | | | E |
| AMV262 | 218411-217797 | 205 | | | | | | x | | | E?,L? |
| AMV263 | 219301-218438 | 288 | AF067136 | PP1 reg subunit 7 hSDS22 homolog [261] | 8.00E−19 | 360 | multiple LRR | | x | | E? |
| AMV264 | 220213-219377 | 279 | AF063866 | MSV099 hp | 7.00E−04 | 519 | TM | | x | | E |
| AMV265 | 221229-220318 | 304 | | | | | TM | x | | | E |
| AMV266 | 221858-221307 | 184 | | | | | | x | | | E |

[a]amino acids.
[b]GenBank accession numbers.
[c]likelihood of identity (EXPECT) score.
[d]predicted domains revealed by Pfam and Psort programs (see materials and methods).
[e]U = genes not found in other poxviruses: E = genes found in other entopropoxviruses: C = genes found in chordopoxviruses.
[f]promoter type E = early: L = late promoters with ambiguous motifs designated by ?. hp = hypothetical protein.
*designates an E score too low to be quantified. Vaccinia homologs are shown in parentheses. MsEPV homologs not already listed are in brackets, braces contain formerly named AmEPV genes.

Figure 9A:
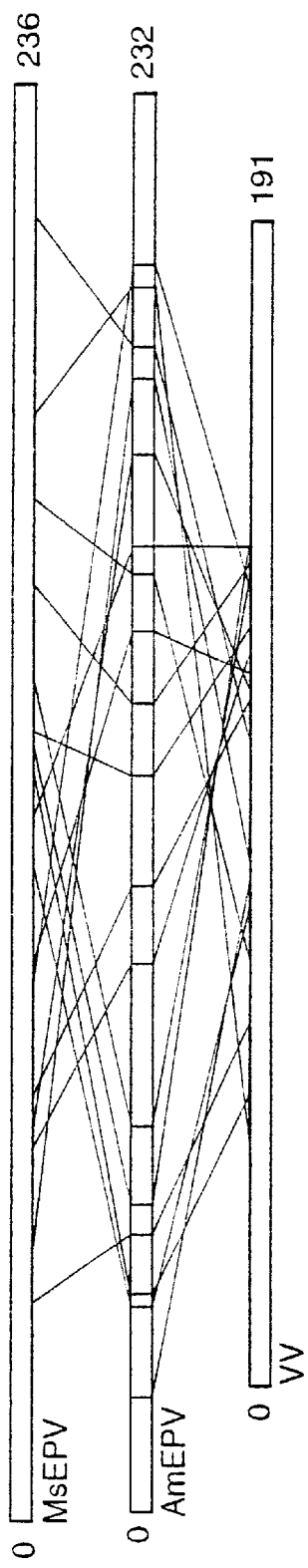
FIGS. 9(A+B) shows a comparison of the spatial distribution of homologous genes between AmEPV, MsEPV and VV. A random sampling of genes conserved within the genomes of all three indicated viruses were plotted on the 119 kb genome of VV, the 232 kb AmEPV genome, and the 236 kb MsEPV genome. From left to right on the AmEPV genome, the genes shown and their BLAST-assigned function are: AMV016, thymidine kinase; AMV035, membrane protein; AMV038, PAP large subunit; AMV050, DNA polymerase; AMV051, RP035; AMV066, RP0132; AMV105, VETF-L; AMV122, rifampicin resistance; AMV138, no BLAST-assigned function; AMV150, ATP/GTP binding protein; AMV166, RPO19; AMV181, core protein; AMV186, no BLAST-assigned function; AMV205, VLTF-3; AMV221, RPO147; AMV232, membrane protein; AMV243, membrane protein; AMV249, no BLAST-assigned function. Plots compare both orientations of the AmEPV genome, (A) left to right, (B) right to left.
Figure 9B:
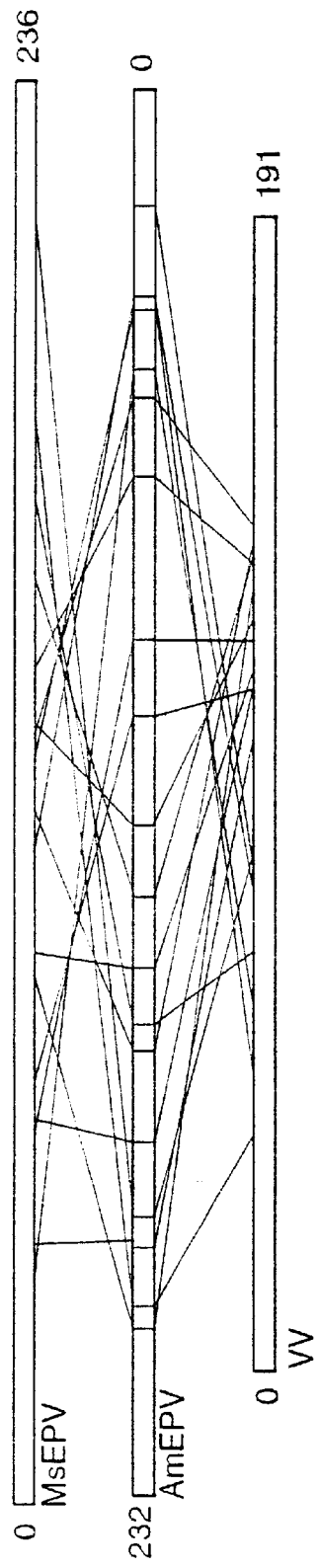

Vertebrate poxviruses have been shown to generally share a co-linear arrangement of core genes (Goebel, S. J., Johnson, G. P., Perkus, M. E., Davis, S. W., Winslow, J. P., and Paoletti, E. [1990] "The complete DNA sequence of vaccinia virus" Virology 179, 247–66, 517–63; Massung, R. F., Liu, L. I., Qi, J., Knight, J. C., Yuran, T. E., Kerlavage, A. R., Parsons, J. M., Venter, J. C., and Esposito, J. J. [1994] "Analysis of the complete genome of smallpox variola major virus strain Bangladesh-1975" Virology 201:215–240; Senkevich, T. G., Koonin, E. V., Bugert, J. J., Darai, G., and Moss, B. [1997] "The genome of molluscum contagiosum virus: Analysis and comparison with other poxviruses" Virology 233:19–42; Afonso, C. L., Tulman, E. R., Lu, Z., Zsak, L., Kutish, G. F., and Rock, D. L. [2000] "The Genome of Fowlpox Virus" J. Virol. 74:3815–3831). Sequence information from a number of EPVs suggested that this co-linear arrangement of core genes is not conserved in members of the EPV subfamily (Hall, R. L., and Moyer, R. W. [1993] "Identification of an Amsacaa spheroidin-like protein within the occlusion bodies of Choristoneura entomopoxviruses" Virology 192:179–187; Sriskantha, A., Osborne, R. J., and Dall, D. J. [1997] "Mapping of the Heliothis armigera entomopoxvirus (HaEPV) genome, and analysis of genes encoding the HaEPV spheroidin and nucleoside triphosphate phosphohydrolase I proteins" J Gen Virol 78:3115–3123: Afonso, C. L., Tulman, E. R., Lu, Z., Oma, E., Kutish G. F., and Rock, D. L. [1999] "The genome of Melanoplus sanguinipes Entomopoxvirus" J. Virol. 73, 533–552). The complete genomic sequence of AmEPV enables us to unequivocally confirm this, but also shows there is no conserved co-linearcore between viruses of genus B. FIG. 9 graphically illustrates the absence of any type of shared spatial gene arrangement between a typical ChPV (VV). MsEPV and the genome of AmEPV. Note that flipping the AmEPV genome direction from 3' to 5' does not lessen the degree of gene shuffling which has occurred within these different viruses.

Promoter Consensus Sequences

AmEPV contains promoter elements which govern gene expression. 133 AmEPV genes are considered to be early, or potentially early. 158 genes possess motifs which result in late, or potentially late promoters. Only 15 genes from the entire 279 gene genome have no recognizable promoter or regulatory elements. Genes that contain the sequences TGAAAXXXXA or TGAATXXXXA within 100 bases of their translational start codons were considered early (E) or potentially early (E?), respectively (Table 1). This motif resembles the ChPV early promoter core consensus sequence (Moss, B. [1996] *Poxviridae*: The viruses and their replication. In "Fields Virology" (B. N. Fields, D. M. Knipe, and P. M. Howley, Eds.). Vol. 2, pp. 2637–2672, Lippincott-Reven, Philadelphia; Senkevich, T. G., Koonin, E. V., Bugert, J. J., Darai, G., and Moss, B. [1997] "The genome of molluscum contagiosum virus: Analysis and comparison with other poxviruses" *Virology* 233:19–42) and was also used to predict early genes of MsEPV (Afonso, C. L., E. R. Tulman, Z. Lu, E. Oma, G. F. Kutish, and D. L. Rock [1999] "The genome of *Melanoplus sanguinipes* Entomopoxvirus" J. Virol. 73:533–552). These motifs have been found upsteam of known EPV early genes such as the TK gene (Gruidl, M. E., Hall, R. L., and Moyer, R. W. [1992] "Mapping and molecular characterization of a functional thymidine kinase from *Amsacta moorei* entomopoxvirus" *Virology* 186:507–516: Lytvyn, V., Fortin, Y., Banville, M., Arif, B., and Richardson, C. [1992] "Comparison of the thymidine kinase genes from three entomopoxviruses" *J. Gen. Virol.* 73:3235–3240). CbEPV DNA polymerase (Mustafa, A. and Yuen, L. [1991] "Identification and sequencing of the *Choristoneura biennis* entomopoxvirus DNA polymerase gene" *DNA Seq.* 2:39–45), and the MmEPV fusolin gene (Li, Y., Hall, R. L., and Moyer, R. W. [1997] "Transient, nonlethal expression of genes in vertebrate cells by recombinant entomopoxviruses" *Virol.* 71:9557–9562; Gauthier, L., Cousserans, F., Veyrunes, J. C., and Bergoin, M. [1995] "The *Melolontha melolontha* entomopoxvirus(MmEPV) fusolin is related to the fusolins of lepidopteran EPVs and to the 37K baculovirus glycoprotein" *Virology* 208:427–436). Out of the 36 early MsEPV gene homologs in AmEPV, 27 contain predicted early promoters. For comparison with vertebrate poxvirus homologs, we adopted the most recently published mammalian poxvirus promoter sequence predictions (Cameron, C., Hoia-Mitchell, S., Chen, L., Barrett, J., Cao, J. X., Macaulay, C., Willer, D., Evans, D., and McFadden, G. [1999] "The complete DNA sequence of myxoma virus" *Virology* 264:298–318; Willer, D. O., McFadden, G., and Evans, D. H. [1999] "The complete genome sequence of shope (Rabbit) fibroma virus" *Virology* 264:319–343), which emanated from the earlier work of Davison and Moss (Davison, A. J. and Moss, B. [1989] "Structure of vaccinia virus late promoters" *J. Mol. Biol.* 210:771–784). Out of the 16 early MYX homologs in AmEPV, 11 contained early promoter elements. As a first approximation, candidate genes were considered early only if they contained the vaccinia virus early transcription termination sequence (TTTTTNT) near the 3' end of the gene; (Gruidl, M. E., Hall, R. L., and Moyer, R. W. [1992] "Mapping and molecular characterization of a functional thymidine kinase from *Amsacta moorei* entomopoxvirus" *Virology* 186:507–516; Li, X., Barrett, J. W., Yuen, L., and Arif, B. M. [1997] "Cloning, sequencing and transcriptional analysis of the *Choristoneura fumiferana* entomopoxvirus spheroidin gene" *Virus Res.* 47:143–154; Sriskantha, A., Osborne, R. J., and Dall, D. J. [1997] "Mapping of the *Heliothis armigera* entomopoxvirus (HaEPV) genome, and analysis of genes encoding the HaEPV spheroidin and nucleoside triphosphate phosphohydrolase I proteins" *J. Gen Virol* 78:3115–3123; Yuen, L. and Moss, B. [1987] "Oligonucleotide sequence signaling transcriptional termination of vaccinia virus early genes" *Proc. Natl. Acad. Sci. U.S.A.* 84:6417–6421). There are examples of early genes which contain the TTTTTNT motif towards the 5' N-terminal portion of the ORF such as the DNA polymerase of myxoma (Cameron, C., Hota-Mitchell, S., Chen, L., Barrett, J., Cao, J. X., Macaulay, C., Willer, D., Evans, D., and McFadden, G. [1999] "The complete DNA sequence of myxoma virus" *Virology* 264:298–318) and Shope fibroma (Willer, D. O., McFadden, G., and Evans, D. H. [1999] "The complete genome sequence of shope (Rabbit) fibroma virus" *Virology* 264:319–343) viruses. Therefore, our estimates of early genes may be low. This sequence is found within 100 bases 3' of the ORF of 42 of the 116 predicted early AmEPV genes.

AmEPV ORFs that contained the sequence TAAATG at the translational start site were considered late genes (L) (Bertholet, C., Stocco, P., Van Meir, E., and Wittek, R. [1986] "Functional analysis of the 5' flanking sequence of a vaccinia virus late gene" *EMBO J.* 5:1951–1957; Rosel, J. and Moss, B. [1985] "Transcriptional and translational mapping and nucleotide sequence analysis of a vaccinia virus gene encoding the precursor of the major core polypeptide 4b" *J. Virol.* 56:830–838; Weir, J. P, and Moss, B. [1984] "Regulation of expression and nucleotide sequence of a late vaccinia virus gene" *J. Virol.* 51:662–669; Davison, A. J. and Moss, B. [1989] "Structure of vaccinia virus late promoters" *J. Mol. Biol.* 210:771–784). This late promoter consensus sequence has been observed in other EPV late genes such as spheroidin, the nucleoside triphosphatase (NTPase), and hydrolase I (NPH-1), and topoisomerase (Hall, R. L., Li, Y., Feller, J. A., and Moyer, R. W. [1996] "The *Amsacta moorei* entomopoxvirus spheroidin gene is improperly transcribed in vertebrate poxviruses" *Virology* 224:427–436; Hall, R. L, and Moyer, R. W. [1991] "Identification.cloning, and sequencing of a fragment of *Amsacta moorei* entomopoxvirus DNA containing the spheroidin gene and three vaccinia virus-related open reading frames" *J. Virol.* 65:6516–6527; Li, X., Barrett, J. W., Yuen, L., and Arif, B. M. [1997] "Cloning, sequencing and transcriptional analysis of the *Choristoneura fumiferana* entomopoxvirus spheroidin gene" *Virus Res.* 47:143–154; Sanz, P., Veyrunes, J. C., Cousserans, F., and Bergoin, M. [1994] "Cloning and sequencing of the spherulin gene, the occlusion body major polypeptide of the *Melolontha melolontha* entomopoxvirus (MmEPV)" *Virology* 202:449–457; Sriskantha, A., Osborne, R. J., and Dall, D. J. [1997] "Mapping of the *Heliothis armigera* entomopoxvirus (HaEPV) genome, and analysis of genes encoding the HaEPV spheroidin and nucleoside triphosphate phosphohydrolase I proteins" *J. Gen Virol* 78:3115–3123). Genes that contained the sequences TAAAT or TAAAAT within 100 bases upstream from their start codon were also potentially considered late genes (L?)

(Table 1). These sequences have been found upstream of other late vertebrate poxvirus genes (Roseman, N. A. and Hruby, D. E. [1987] "Nucleotide sequence and transcript organization of a region of the vaccinia virus genome which encodes a constitutively expressed gene required for DNA replication" *J. Virol.* 61:1398–1406).

Terminal Regions

AmEPV is one of the few entompoxviruses which can be easily and reliably replicated in tissue culture (Winter, J., Hall, R. L., and Moyer, R. W. [1995] "The effect of inhibitors on the growth of the entomopoxvirus from *Amsacta moorei* in *Lymantria dispar* (gypsy moth) cells" *Virology* 211: 462–473; Hall, R. L., Li, Y., Feller, J. A., and Moyer, R. W. [1996] "The *Amsacta moorei* entomopoxvirus spheroidin gene is improperly transcribed in vertebrate poxviruses" *Virology* 224:427–436). Because of this, we were able to obtain DNA for sequencing from a single clonal virus plaque, thus minimizing template heterogeneity. The results of sequencing from non-clonally isolated template DNA can be seen in the resultant sequence of MsEPV, where the two inverted terminal repeat (ITR) regions are not identical (Afonso, C. L., Tulman, E. R., Lu, Z., Oma, E., Kutish, G. F., and Rock, D. L. [1999] "The genome of *Melanoplus sanguinipes* Entomopoxvirus" *J. Virol.* 73, 533–552).

Poxvirus ITRs can vary considerably in size. The smallest ITRs are those of variola Bangladesh which are only 725 bp (Massung, R. F., Esposito, J. J., Liu, L. I., Qi, J., Utterback, T. R., Knight, J. C., Aubin, L., Yuran, T. E., Parsons, J. M., Loparev, V. N., Selivanov, N. A., Cavallaro, K. F., Kerlavage, A. R., Mahy, B. W. J., and Venter, J. C. [1993] "Potential virulence determinants in terminal regions of variola smallpox virus genome" *Nature* 366:748–751; Massung, R. F., Liu, L. I., Qi, J., Knight, J. C., Yuran, T. E., Kerlavage, A. R., Parsons, J. M., Venter, J. C., and Esposito, J. J. [1994] "Analysis of the complete genome of smallpox variola major virus strain Bangladesh-1975" *Virology* 201:215–240). The AmEPV genome contains identical ITR tandem repeats of 9.4 kbp at both termini which are organized in a fashion similar to that of other poxviruses; i.e. a series of tandemly repeated sequences interspersed with non-repetitive spacer region (FIG. 1) (Massung, R. F., Knight, J. C., and Esposito, J. J. [1995] "Topography of variola smallpox virus inverted terminal repeats" *Virology* 211:350–355; Wittek, R., Menna, A., Muller, H. K., Schumperli, D., Boseley, P. G., and Wyler, R. [1978] "Inverted terminal repeats in rabbit poxvirus and vaccinia virus DNA" *J. Virol.* 28:171–181; Upton, C. and McFadden, G. [1986] "DNA sequence homology between the terminal inverted repeats of Shope fibroma virus and an endogenous cellular plasmid species" *Mol. Cell Biol.* 6, 265–276; Afonso, C. L., Tulman, E. R., Lu, Z., Oma, E., Kutish, G. F., and Rock, D. L. [1999] "The genome of *Melanoplus sanguinipes* Entomopoxvirus" *J. Virol.* 73, 533–552). Myxoma virus and AmEPV share a similar ITR structure, in that the ORFs encoded in this region extend to the very ends of the genome termini, and contain very little non-coding DNA (Cameron, C., Hota-Mitchell, S., Chen, L., Barrett, J., Cao, J. X., Macaulay, C., Willer, D., Evans, D., and McFadden, G. [1999] "The complete DNA sequence of myxoma virus" *Virology* 264:298–318). Other sequenced poxvirus ITRs contain smaller numbers of genes interspersed with large regions of non-coding DNA within them. Other examples of poxvirus ITRs include MsEPV, which contains 3 kb of non-coding DNA within the ITRs (Afonso, C. L., Tulman, E. R., Lu, Z., Oma, E., Kutish, G. F., and Rock, D. L. [1999] "The genome of *Melanoplus sanguinipes* Entomopoxvirus" *J. Virol.* 73, 533–552). 6 kb in VV Ankara strain (Antoine, G., Scheiflinger, F., Dorner, F., and Falkner, F. G. [1998] "The complete genomic sequence of the modified vaccinia Ankara strain: Comparison with other orthopoxviruses" *Virology* 244:365–396) and 3 kb in MCV (Senkevich, T. G., Koonin, E. V., Bugert, J. J., Darai, G., and Moss, B. [1997] "The genome of molluscum contagiosum virus: Analysis and comparison with other poxviruses" *Virology* 233:19–42). As seen in Table 1, each of the ORFs within the AmEPV ITR encodes a protein with no BLAST-derived function. The exception to this is AMVITR1. This most terminal gene has homology to MsEPV MSV010. Although this gene is not within the ITR region of the MsEPV genome, it is located towards the left terminus. The gene encodes a member of the leucine rich gene family protein.

Spontaneous DNA arrangements occur with an increased frequency at or near the terminal inverted repeat sequences of poxviral genomes (Moyer, R. W., Graves, R. L., and Rothe, C. T. [1980] "The white pock (mu) mutants of rabbit poxvirus. III. Terminal DNA sequence duplication and transposition in rabbit poxvirus" *Cell* 22:545–553). Indeed, the majority of novel and non-essential genes are generally found within poxviral ITRs or toward the genomic termini.

AmEPV and Vertebrate Poxvirus Gene Homologs

The complete genomic sequences of vaccinia and variola viruses from the orthopoxvirus genus, myxoma and Shope fibroma viruses from the leporipoxvirus genus, fowlpox from the avipoxvirus genus, the molluscipoxvirus molluscum contagiosum and the genus B EPV, MsEPV have allowed definition of conserved poxvirus genes present in most, if not all, poxviruses. Inclusion of the AmEPV genomic sequence extends that concept.

Inspection of the AmEPV sequence shows 52 ORFs which have homology to genes found in ChPV (Table 2). Of these, 44 have been assigned a function. Of the 44 ORFs with an assigned function, 18 are derived from proteins involved in mRNA synthesis which include 5 ORFs comprising an RNA polymerase, 4 ORFs likely to encode transcription factors, 3 ORFs related to helicases/NTPases and 5 ORFs devoted to post-transcriptional mRNA modifications. Of the ORFs devoted to mRNA modification, the poly(A) polymerase deserves special mention. Normally, this heterodimeric enzyme consists of a large and small subunit. However, the AmEPV sequence reveals the presence of three rather than the expected two potential subunits. The ORFs AMV038, AMV060 and AMV 115 are predicted to represent one large and two small poly(A) polymerase subunits respectively. This unusual feature will be discussed in a subsequent section. There are 7 homologous ORFs involved in functions of DNA replication/repair, which include a DNA polymerase, photolyase, nucleotide phosphohydrolase, DNA topoisomerase and a uracil DNA glycosylase. Interestingly, neither AmEPV nor MsEPV encode a homolog of the vaccinia I3L protein. The I3L protein is a DNA binding protein and is presumably involved in DNA replication (Davis, R. E, and Mathews, C. K. [1993] "Acidic C terminus of vaccinia virus DNA-binding protein interacts with ribonucleotide reductase" *Proc. Natl. Acad. Sci. U.S.A.* 90:745–749). Ten ChPV/EPV ORFs are associated with conserved virus structural proteins. Finally, there are 8 ORFS associated with enzymatic activities not strictly related to nucleic acid metabolism.

TABLE 2

Chordopoxvirus homologs found within AmEPV.

| AmEPV ORF | Length amino acids | MsEPV ORF | Length amino acids | VV ORF | Length amino acids | Gene name and/or function |
|---|---|---|---|---|---|---|
| *Transcription/RNA Modification* | | | | | | |
| *RNA polymerase* | | | | | | |
| AMV051 | 349 | 149 | 348 | A29L | 305 | RPO35 |
| AMV054 | 822 | 119 | 807 | H4L | 795 | RAP94 |
| AMV066 | 1196 | 155 | 1190 | A24R | 1164 | RPO132 |
| AMV166 | 237 | 100 | 230 | A5R | 164 | RPO19 |
| AMV221 | 1301 | 43 | 1319 | J6R | 1286 | RPO147 |
| AMV230 | 179 | 245 | 186 | D7R | 161 | RPO18 |
| *Transcription Factors* | | | | | | |
| AMV047 | 259 | 187 | 261 | A1L | 150 | VLTF-2 |
| AMV091 | 356 | 52 | 345 | A23R | 382 | transcription factor |
| AMV105 | 767 | 63 | 760 | A7L | 710 | VETF-L |
| AMV174 | 670 | 113 | 674 | D6R | 637 | VETF-s |
| AMV205 | 228 | 65 | 218 | A2L | 224 | VLTF-3 |
| *NTPase/helicase* | | | | | | |
| AMV059 | 469 | 148 | 471 | A18R | 493 | DNA helicase |
| AMV081 | 720 | 86 | 717 | I8R | 676 | RNA helicase |
| AMV192 | 648 | 53 | 647 | D11L | 631 | NPH-I |
| *mRNA modification* | | | | | | |
| AMV038 | 573 | 143 | 571 | E1L | 479 | PAP-L |
| AMV060 | 295 | 41 | 293 | J3R | 333 | PAP-S |
| AMV093 | 262 | 124 | 267 | D12L | 287 | mRNA capping small subunit |
| AMV115 | 293 | 41 | 295 | J3R | 333 | PAP-S |
| AMV135 | 627 | 67 | 860 | D1R | 844 | mRNA capping large subunit |
| *DNA replication/ repair* | | | | | | |
| AMV016 | 182 | N/A | N/A | J2R | 177 | Thymidine Kinase |
| AMV025 | 453 | 235 | 466 | S127L* | 445 | CPD photolyase |
| AMV050 | 1105 | 36 | 964 | E9L | 1006 | DNA polymerase |
| AMV052 | 333 | 130 | 328 | H6R | 314 | DNA topoisomerase |
| AMV058 | 276 | 150 | 289 | D10R | 248 | NTP pyrophospho-hydorlase/mutT |
| AMV087 | 726 | 89 | 834 | D5R | 785 | NTPase |
| AMV231 | 344 | 208 | 232 | D4R | 218 | uracil DNA glycosylase UNG |
| *Structural* | | | | | | |
| AMV035 | 336 | 121 | 333 | G9R | 340 | membrane protein |
| AMV061 | 255 | 158 | 293 | L4R | 251 | 30K virion protein |
| AMV118 | 386 | 90 | 380 | A16L | 378 | membrane protein |
| AMV122 | 567 | 69 | 584 | D13L | 551 | rifampicin resistance gene |
| AMV139 | 1149 | 152 | 1306 | A10L | 891 | P4a core protein |
| AMV147 | 688 | 164 | 648 | A3L | 644 | P4b core protein |
| AMV181 | 464 | 189 | 464 | I7L | 423 | core protein |
| AMV217 | 246 | 183 | 242 | L1R | 250 | myristylated membrane protein |
| AMV232 | 140 | 142 | 139 | J5L | 133 | membrane protein |
| AMV243 | 248 | 94 | 241 | F9L | 212 | membrane protein |
| *Enzymes* | | | | | | |
| AMV078 | 165 | N/A | N/A | S069L* | 173 | protein tyrosine phosphatase |
| AMV114 | 105 | 93 | 107 | E10R | 95 | put. redox |
| AMV133 | 287 | 48 | 288 | M5L** | 75 | lipase |
| AMV150 | 240 | 171 | 244 | A32L | 300 | ATP/GTP binding protein |
| AMV153 | 468 | 173 | 457 | F10L | 439 | Ser/Thr protein kinase |
| AMV197 | 299 | 154 | 396 | B1R | 300 | Ser/Thr protein kinase |
| AMV256 | 609 | 56 | 629 | G1L | 591 | metalloprotease |
| AMV255 | 152 | N/A | N/A | A45R | 163 | Cu—Zn superoxide dismutase |

TABLE 2-continued

Chordopoxvirus homologs found within AmEPV.

| AmEPV ORF | Length amino acids | MsEPV ORF | Length amino acids | VV ORF | Length amino acids | Gene name and/or function |
|---|---|---|---|---|---|---|
| Others | | | | | | |
| AMV041 | 213 | 39 | 193 | G6R | 165 | |
| AMV069 | 348 | 180 | 343 | L3L | 350 | |
| AMV127 | 195 | 60 | 194 | H2R | 189 | |
| AMV138 | 320 | 151 | 313 | A11R | 318 | |
| AMV162 | 163 | 106 | 163 | A22R | 176 | |
| AMV179 | 416 | 115 | 505 | G5R | 434 | |
| AMV186 | 161 | 132 | 181 | A28L | 146 | |
| AMV249 | 112 | 209 | 113 | A21L | 117 | |

All ChPV homolog ORF's shown are from VV. Where no homolog exists, *SFV, and **CPV.

Several of the genes included in Table 2 showing AmEPV vertebrate poxvirus homologs are not universally conserved, but are nevertheless present in many poxviruses. One example is the thymidine kinase (TK) gene. AmEPV encodes a TK gene, as do most ChPV and most other genus B EPVs investigated to date (Lytvyn, V., Fortin, Y., Banville, M., Arif, B., and Richardson, C. [1992] "Comparison of the thymidine kinase genes from three entomopoxviruses" *J. Gen. Virol.* 73:3235–3240). However, the gene is noticeably absent from both molluscum contagiosum and MsEPV (Senkevich, T. G., Koonin, E. V., Bugert, J. J., Darai, G., and Moss, B. [1997] "The genome of molluscum contagiosum virus: Analysis and comparison with other poxviruses" *Virology* 233:19–42; Afonso, C. L., Tulman, E. R., Lu, Z., Oma, E., Kutish, G. F., and Rock, D. L. [1999] "The genome of *Melanoplus sanguinipes* Entomopoxvirus" *J. Virol.* 73, 533–552). Perhaps as previously suggested in the case of the MsEPV, the absence of a TK and other enzymes related to nucleotide biosynthesis is reflective of a differential dependence on host biosynthetic pathways (Afonso et al. [1999] supra). Similarly, the CPD photolyase is not universally conserved within all members of the poxvirus family, but is present in a number of different viruses. Also of note is MsEPV ORF237, which is homologous to vaccinia virus B2R (Afonso et al. [1999] supra; Goebel, S. J., Johnson, G. P., Perkus, M. E., Davis, S. W., Winslow, J. P., and Paoletti, E. [1990] "The complete DNA sequence of vaccinia virus" *Virology* 179, 247–66, 517–63). This ORF, found at the right termini of both viruses, is absent from the genome of AmEPV. Likewise, a Cu/Zn superoxide dismutase (SOD) found within AmEPV (AMV255) is absent from the genome of MsEPV, and is fragmented or partially deleted in many orthopoxviruses (Smith, G. L., Chan, Y. S., and Howard, S. T. [1991] "Nucleotide sequence of 42 kbp of vaccinia virus strain WR from near the right inverted terminal repeat" *J. Gen. Virol.* 72:1349–1376; Cameron, C., Hota-Mitchell, S., Chen, L., Barrett, J., Cao, J. X., Macaulay, C., Willer, D., Evans, D., and McFadden, G. [1999] "The complete DNA sequence of myxoma virus" *Virology* 264:298–318). Both EPVs also encode a homolog of the A21L protein of VV. The A21L protein has been shown to interact with the A6L protein using the two hybrid system (McCraith, S., Holtzman, T., Moss, B., and Fields, S. [2000] "Genome-wide analysis of vaccinia virus protein-protein interactions" *Proc. Natl. Acad. Sci. U.S.A* 97:4879–4884). Interestingly, there is no homolog of the A6L protein in either EPV. Therefore, with the exception of the TK, SOD, protein tyrosine phosphatase and VV B2R, AmEPV and MsEPV share the same suite of ChPV virus homologs.

A Comparison of ORF Content Between AmEPV and Other EPVs

As well as the core poxviral genes shared between ChPV and EPV shown in Table 2, there are a number of genes which are shared between sequenced entomopoxviruses ie. AmEPV and MsEPV. Limited sequence data is also available from various regions of other entomopoxviruses currently under investigation. Given the vastly differing host requirements of the ChPVs and EPVs, it is not unexpected that many genes differ between the two subfamilies. Approximately one third of genes encoded by ChPVs are responsible for a response against host immune defense systems (Gooding, L. R. [1992] "Virus proteins that counteract host immune defenses" *Cell* 71:5–7; Smith, G. L. [1994] "Virus strategies for evasion of the host response to infection" *Trends in Microbiol.* 2:81–88; Smith, G. L. [2000] "Secreted poxvirus proteins that interact with the immune system" *Effects of Microbes on the Immune System* 491–507). The 69 genes shared between MsEPV and AmEPV (but absent in ChPV's) are likely involved in insect specific interactions. The pattern of gene organization within the genome of Genus B EPVs has long been realized to be distinct from those of the ChPVs (Hall, R. L, and Moyer, R. W. [1991] "Identification, cloning, and sequencing of a fragment of *Amsacta moorei* entomopoxvirus DNA containing the spheroidin gene and three vaccinia virus-related open reading frames" *J. Virol.* 65:6516–6527; Sriskantha et al. [1997] supra; Afonso et al. [1999] supra). However it is now also evident that within genus B, obvious reorganization has occurred. For example, the NPH-1 and spheroidin homologs are immediately adjacent in all other known genus B viruses from *Choristoneura* and *Heliothis*, but are separated by 20 kb in MsEPV. Similarly, the juxtaposed A23R protein and NPH-1 homolog in MsEPV are separated by 78 kb in the AmEPV genome. Although there are no areas of organizational identity between the MsEPV and AmEPV genomes, there is one region of AmEPV genes (AMV159–AMV164) which contains homologs to MsEPV genes in the order of MSV111, 110, 108, 106, 112, 107. Given the lack of spatial conservation and degree of gene shuffling between MsEPV and AmEPV genes in all other areas of the AmEPV genome, small groups of genes may be present as the last remnants of divergence from a common ancestor. Alternatively, small clusters might have remained in close proximity to each other due to a more recent acquisition or for functional or regulatory reasons. Albeit not as striking an example, the homologs of MsEPV genes MSV085–MSV089 are also non-sequentially grouped within a 9 gene assembly within AmEPV (AMV079–AMV087). For these reasons, it is likely a conserved colinear core of genes may only be shared among the lepidopteran viruses within EPV genus B (Afonso et al. [1999] supra).

In this regard, the comparative alignment of two lepidopteran group B viruses, AmEPV and published HaEPV genes, does reveal some organizational similarities. Certain co-linear regions do appear to be shared. Positions of the spheroidin, NPH-1, "Q3" and DNA polymerases are all similarly situated within the genomes of the two viruses. The juxtaposed HaEPV PAP2, 30K and ORF4 genes are also immediately adjacent and co-linear in AmEPV, with ORF direction preserved (AMV060, AMV061 and AMV062) (Cmov and Dall 1999). Comparative alignments have also highlighted differences between these two more closely related genus B lepidopteran EPVs. For example, the large RNA polymerase of HaEPV is located toward the leftmost end of the genome, whereas it is positioned at the right end of AmEPV. Likewise the "17K" ORF of HaEPV is duplicated and terminally located within its ITRs, but homologous regions within AmEPV are not repeated, and are positioned approximately one hundred genes from the genomic termini. Whether or not a generally co-linear arrangement of genes emerges for the lepidopteran EPVs, it is obvious that EPVs in general have not followed the evolutionary direction of ChPV which has enabled them to retain a common co-linear gene core.

Clearly, genes shared between AmEPV and MsEPV are not arranged in a co-linear fashion and based on overall gene organization, MsEPV and AmEPV may be far more distantly related than the current common morphologically based classification as genus B EPVs would suggest. There are two possibilities to explain this divergence in gene order between AmEPV (lepidopteron) and MsEPV (orthopteran) viruses. One model employs a large evolutionary gap between the two viruses. A second model is based on intrinsic genomic plasticity and generalized movement of genes within the viral chromosome of EPVs. Comparative homologies among essential genes: e.g. RNA polymerase subunits, suggests MsEPV and Am EPV are more closely related to each other than either is to ChPVs homologs. Therefore, it may well be that plasticity or position independent location of genes within EPVs plays a significant role in the creation of divergent gene orders.

AmEPV encodes an additional 27 gene homologs not found within ChPV or MsEPV, but which are present in other insect viruses including baculoviruses (AcNPV, XcGV, SeNPV, CpGV, LdNPV and TnGV) and an iridovirus (Chilo iridescent virus). The majority of these genes have previously been assigned functions, and a number are not specific to insect viruses alone (see Table 1).

AmEPV Gene Families

MsEPV was found to encode 43 novel ORFs which could be grouped into five gene families of varying stringency. Examination of the AmEPV genomic sequence revealed the presence of 23 genes which can be grouped into six gene families (Table 3).

TABLE 3

AmEPV Gene Families.

| Gene family | AMV ORF | Size (aa) | Homology |
|---|---|---|---|
| AMV716 | AMV056 | 86 | none |
|  | AMV176 | 86 | none |
|  | AMV178 | 86 | none |

TABLE 3-continued

AmEPV Gene Families.

| Gene family | AMV ORF | Size (aa) | Homology |
|---|---|---|---|
| ALI-like | AMV055 | 133 | HaEPV ORF6/MSV194 |
|  | AMV057 | 352 | HaEPV ORF6/MSV194 |
|  | AMV175 | 346 | HaEPV ORF6/MSV194 |
|  | AMV177 | 360 | HaEPV ORF6/MSV194 |
|  | AMV257 | 125 | MSV196 |
| MTG-like | AMV194 | 472 | MSV198 |
|  | AMV207 | 476 | MSV198 |
|  | AMV209 | 463 | MSV198 |
| Tryptophan | AMV029 | 290 | MSV027 |
|  | AMV254 | 215 | MSV027 |
| 17K ORF | AMV024 | 354 | HaEPV 17K ORF/FPV124 |
|  | AMV110 | 362 | HaEPV 17K ORF/FPV124 |
|  | AMV112 | 348 | HaEPV 17K ORF/FPV124 |
|  | AMV100 | 136 | HaEPV 17K ORF/FPV248 |
|  | AMV132 | 207 | HaEPV 17K ORF/FPV248 |
| LRR | AMVITR1 | 460 | MSV010 |
|  | AMV005 | 350 | MSV011 |
|  | AMV014 | 486 | MSV240 |
|  | AMV076 | 117 | MSV255 |
|  | AMV134 | 535 | MSV240 |

The AMV176 gene family has no homology to any proteins within current databases. Each of these 86 residue proteins is identical, except for a single nucleotide substitution in AMV056 which results in an isoleucine codon at residue 37, instead of the leucine coded by both AMV176 and AMV178. It is unusual to observe perfect copies of genes within a gene family. All members of the family are predicted to contain a transmembrane domain.

The five member ALI-like (alanine-leucine-isoleucine) gene family largely comprises ORFs related to the AMV176 gene family discussed above. The ORFs do not possess any motifs indicative of transmembrane domains or signal sequences. AMV055, appears to be a carboxy terminal truncated member of this family. This 133 residue ORF shares a large number of residue identities with the other family members. The final member of the family, AMV257, appears to be truncated at the N-terminus, and is less related to the other members of this family. Nevertheless, its homology to MSV 196 warrants its inclusion in this group.

A third MTG-like gene family has three members; AMV194, AMV207 and AMV209. There is a 69% identity between AMV207 and AMV209. AMV194 is somewhat less related to the other family members. Each gene was identified independantly based on its homology to the MTG gene family ORF MSV198 found in MsEPV. However, the invariant signature MTG (methionine-threonine-glycine) motif is absent from all AmEPV proteins, and an expected internal motif found within the MsEPV proteins was found to be degenerate.

A fourth family comprising only AMV029 and AMV254 shows homology to MsEPV ORF MSV027, which is a member of the tryptophan repeat gene family. Both AmEPV ORFs contain the expected motifs, although AMV029 does show degeneracy.

The fifth, 17K ORF gene family, contains five members which do not show any homology to MsEPV proteins, but are instead related to the 17K ORF of HaEPV. AMV024, AMV110 and AMV112 show excellent conservation at both their amino and carboxy termini, with a 60 residue internal portion of lesser similarity. Interestingly, these three genes also show homology with the N1R/p28 gene family of FPV (FPV124). AMV100 and AMV132 are also homologous to the HaEPV 17K ORF, and to FPV248, but less so. There is no homology between these two predicted AmEPV proteins themselves. Fifteen residues are shared between all members of this family.

The sixth gene family is the LRR (leucine-rich repeat) gene family which contains five AmEPV genes based upon the position of a motif containing regularly spaced leucine residues. There is a large LRR gene family in MsEPV. Each of the five members of the AmEPV LRR-like family shows homology to an LRR gene family protein of MsEPV. AMVITR1 and AMV005 are 63% identical, and very well conserved at their amino terminus. AMV014 and AMV134 share regions of homology along their lengths. At 117 residues. AMV076 is significantly smaller than other LRR-like gene family members (varying from 350 to 535 residues). However, when aligned with all other family members, an internal conserved motif emerges which includes seven leucine or isoleucine residues.

AmEPV ORFs Encoding Unique Gene Products

Figure 7A:
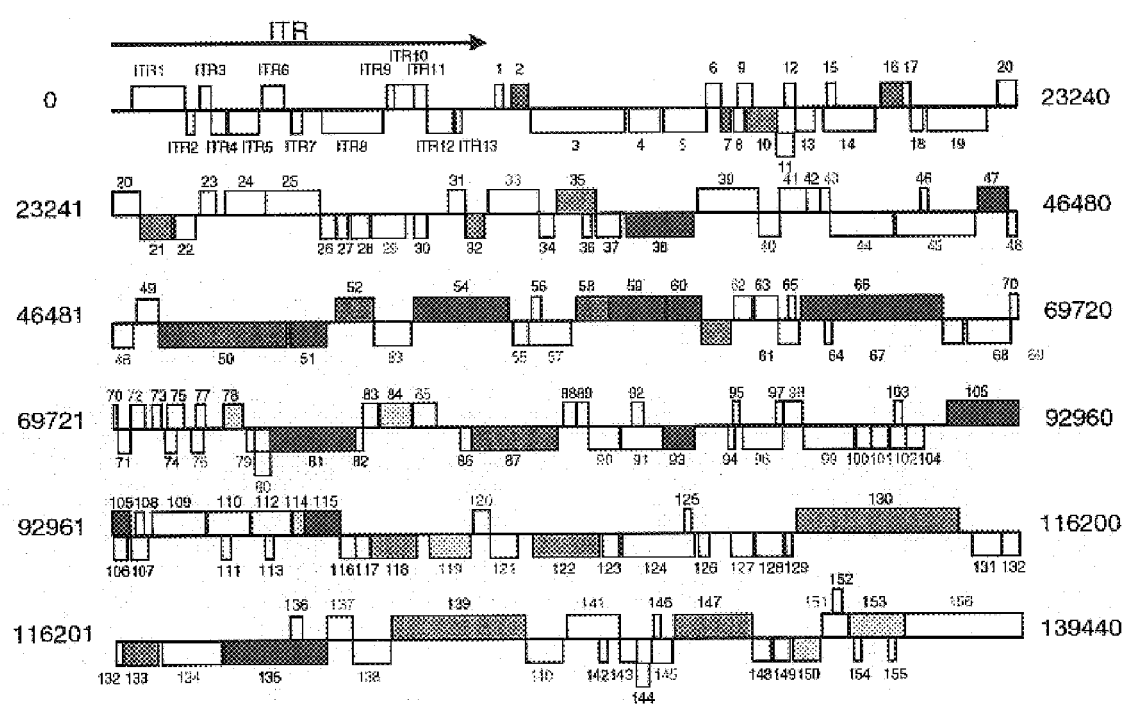
FIGS. 7(A+B) shows a linear map of the AmEPV genome, 0-139440(A) and 139441-232392(B). Predicted ORFs are numbered consecutively from left to right based upon the position of the initiating methionine codon. ORFs transcribed in a rightward direction are shown above the horizontal line designating the viral genome; ORFs transcribed to the left are below. ITRs are indicated by heavy black arrows. A distance of 1 kb is as shown. ChPV homologs are indicated with red numbers, additional MsEPV homologs are indicated with purple numbers. Some ORFs have been assigned function based upon BLAST data.
Figure 7B:
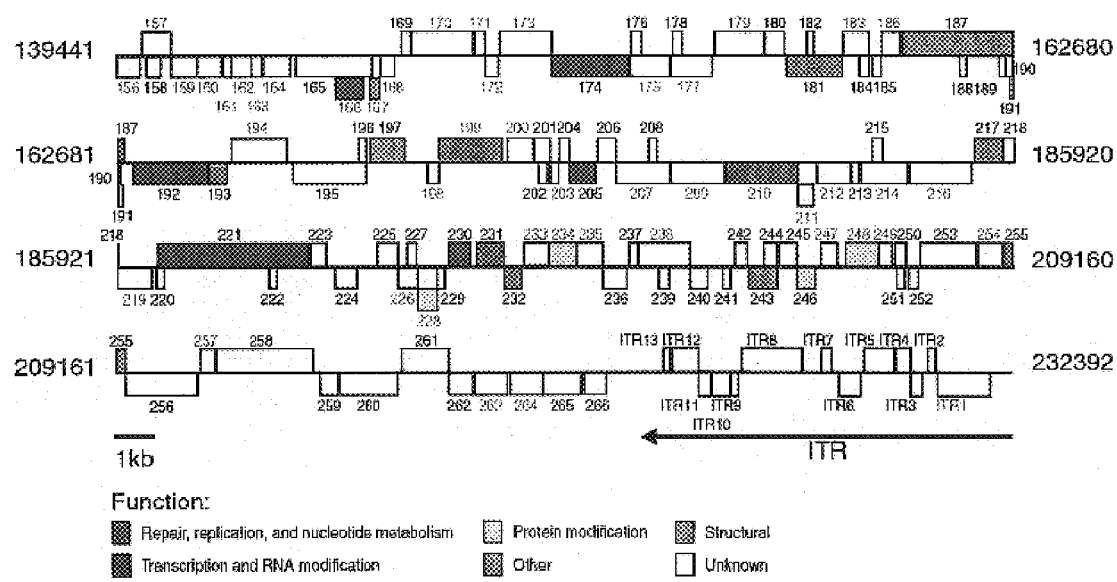

The majority of the unique AmEPV genes are located at the terminal extremes of the virus genome, as can be easily observed in FIG. 7. More than one third of AmEPV ORFs (128 out of 279) show no homology to any sequences currently in the databases. We have classified these novel ORFs on the basis of whether they contain a predicted transmembrane domain (TM) and/or signal peptide (SP). Based on this classification, 4 ORFs possess predicted TM and SP domains, 3 an SP only, 56 a TM alone, and 65 possess neither. We expect that like the ChPV, a number of AmEPV genes are devoted to overcoming host defense responses.

Most genes encoded by AmEPV have homologs in ChPVs, EPVs or other insect viruses. In addition, there are a number of ORFs unique to AmEPV. There are also ORFs of interest potentially involved in host pathogenesis or virulence, such as AMV133 (SEQ ID NO: 1) which encodes a lipase, AMV255 (SEQ ID NO: 2) which encodes a superoxide dismutase (SOD). AMV025 (SEQ ID NO: 3) encoding a CPD photolyase and AMV021 (SEQ ID NO: 4) which encodes a baculovirus-like inhibitor of apoptosis (IAP). The following paragraphs briefly discuss each of these genes and their expected interactions with the host immune system.

AMV133 (SEQ ID NO: 1) encodes a AmEPV triacylglyceride lipase gene which could conceivably function as a virulence gene through lipid hydrolysis. AmEPV has been shown to launch a promiscuous infection within the insect, including the fat body (Arif, B. M. and Kurstak, E. [1991]. The Entomopoxviruses. In "Viruses of Invertebrates." E. Kurstak, Ed., pp. 175–195. Marcel Dekker, Inc., New York), which is the major site of lipid storage (Chapman, R. F. [1998] Circulatory system, blood and immune systems. In "The Insects" pp. 94–131, Cambridge University Press, Cambridge). Although AmEPV infected insects do not undergo the "melting" phenotype associated with baculovirus infection, lipid hydrolysis would be anticipated to increase viral virulence, as has also been suggested for the lipase gene of MsEPV (Afonso et al. [1999] supra). Ectromelia and CPV are the only other poxviruses which encode similar proteins, and these are thought to play a role in the viral inflammatory response (Wall, E. M., Cao, J. X., Chen, N. H., Buller, R. L., and Upton, C. [1997] "A novel poxvirus gene and its human homolog are similar to an E-coli Lysophospholipase" Virus Res. 52:157–167).

AmEPV AMV255 (SEQ ID NO: 2) encodes a $Cu^{++}/Zn^{++}$ superoxide dismutase homolog. These proteins are widespread in nature and are recognized as a primary defense against the damage of superoxide radicals (Fridovich, I. [1997] "Superoxide anion radical (O2-.), superoxide dismutases, and related matters" J. Biol. Chem. 272:18515–18517). Although the SOD homolog was initially discovered in a baculovirus (Tomalski, M. D., Eldridge, R., and Miller, L. K. [1991] "A baculovirus homolog of a Cu/Zn superoxide dismutase gene" Virology 184, 149–161), all sequenced ChPVs have also been found to encode a vestige of a SOD. However, many include deletions or substitutions within the coding region which render the protein inactive (Smith, G. L., Chan, Y. S., and Howard, S. T. [1991] "Nucleotide sequence of 42 kbp of vaccinia virus strain WR from near the right inverted terminal repeat" J. Gen. Virol. 72, 1349–1376; Willer et al. [1999] supra) but the AmEPV homolog appears to be intact. MsEPV does not encode a sod (Afonso et al. [1999] supra).

During their life cycle, most insect viruses spend some period of time exposed to potentially detrimental environmental conditions. Therefore it is somewhat surprising that more insect viral genomes do not contain light-dependant DNA-repair mechanisms. AmEPV AMV025 (SEQ ID NO: 3) and MsEPV both encode a CPD photolyase homolog, as do the ChPV SFV and MYX. These are the only reports of virally encoded CPD photolyases.

Viruses have evolved various strategies to inhibit apoptosis, thereby allowing intracellular viral replication. In ChPVs, apoptosis is controlled in part by serpins (Petit, F., Bergagnoli, S., Gelfi, J., Fassy, F., Boucraut-Baralon, C., and Milon, A. [1996] "Characterization of a myxoma virus-encoded serpin-like protein with activity against interleukin-1b converting enzyme" J. Virol. 70:5860–5866; Ray, C. A., Black, R. A., Kronheim, S. R., Greenstreet, T. A., Sleath, P. R., Salvesen, G. S., and Pickup, D. J. [1992] "Viral inhibition of inflammation: cowpox virus encodes an inhibitor of the interleukin-1 beta converting enzyme" Cell 69:597–604; Spriggs, M. K., Hruby, D. E., Maliszeswki, C. R., Pickup, D. J., Sims, J. E., Buller, R. M. L., and VanSlyke, J. [1992] "Vaccinia and Cowpox viruses encode a novel secreted interleukin-1 binding protein" Cell 71:145–152; Ray, C. A, and Pickup, D. J. [1996] "The mode of death of pig kidney cells infected with cowpox virus is governed by the expression of the crmA gene" Virology 217:384–391; Macen, J., Takahashi, A., Moon, K. B., Nathaniel, R., Turner, P. C., and Moyer, R. W. [1998] "Activation of caspases in pig kidney cells infected with wild-type and CrmA/SPI-2 mutants of cowpox and rabbitpox viruses" J. Virol. 72:3524–3533; Turner, P. C. and Moyer, R. W. [1998] "Control of apoptosis by poxviruses, Seminars in Virology 8:453–469). Insect viruses control apoptosis through either p35 or through a series of inhibitor of apoptosis (IAP) proteins (Deveraux, Q. L. and Reed, T. C. [1999] "IAP family proteins—suppressors of apoptosis" Genes & Development 13:239–252; Miller, L. K. [1999] "An exegesis of IAPs: salvation and surprises from BIR motifs" Trends Cell Biol. 9:323–328; Manji, G. A., Hozak, R. R., LaCount, D. J., and Friesen, P. D. [1997] "Baculovirus inhibitor of apoptosis functions at or upstream of the apoptotic suppressor P35 to prevent programmed cell death" J. Virol. 71:4509–4516). AMV021 (SEQ ID NO: 4) encodes one such inhibitor of apoptosis protein (IAP), and contains two typical baculovirus IAP repeats and a C-terminal RING finger motif. The AMV021 ORF shows significant identity to the IAP of Cydia pomonella granulosis virus (47%), which has previously been shown to be functionally active (Crook, N. E., Clem, R. J., and Miller, L. K. [1993] "An apoptosis-inhibiting baculovirus gene with a zinc finger-like motif" J. Virol. 67:2168–2174). AmEPV and MsEPV are the only poxviruses found to encode IAPs. These proteins have only been noted in the genomes of viruses which infect insect or arthropod hosts.

The following are several different ORFs encoded by AmEPV, which are notable either because they currently do not have homologs in any published viral sequence to date or possess novel aspects of previously described poxvirus genes.

AMV060 (SEQ ID NO: 5) and AMV115 (SEQ ID NO: 6) encode a first and second AmEPV poly(A) polymerase subunit. ORFs AMV060 and AMV115 present a completely unanticipated variation of a well detailed poxvirus encoded enzyme, the poly(A) polymerase. The cytoplasmic synthesis of poxvirus mRNAs involves not only transcription of a given gene by the viral RNA polymerase, but also post-transcriptional modification of the transcripts, including 3' poly(A) addition and 5' capping as well as 2'O-methylation. In the case of VV, addition of poly(A) to transcripts and 2'-methylation of the mRNAs involves a heterodimeric poly(A) polymerase consisting of one large (VP55) and one single small (VP39) subunit encoded by two distinct ORFs (Brakel, C. and Kates, J. R. [1974] "Poly(A) polymerase from vaccinia virus-infected cells. I. Partial purification and characterization" J. Virol 14:715–723; Gershon, P. D., Ahn, B. Y., Garfield, M., and Moss, B. [1991] "Poly(A) polymerase and a dissociable polyadenylation stimulatory factor encoded by vaccinia virus" Cell 66:1269–1278: Schnierle, B. S., Gershon, P. D., and Moss, B. [1992] "Cap-specific mRNA (nucleoside-O2'-)-methyltransferase and poly(A) polymerase stimulatory activities of vaccinia virus are mediated by a single protein" Proc. Natl. Acad. Sci. U.S.A. 89:2897–2901).

The AmEPV genomic sequence has revealed an unusual feature of the poly(A) polymerase in this entomopoxvirus. Like other poxviruses, there is a single, large subunit (AMV038) (SEQ ID NO: 11) of approximately 570 amino acids. This is similar in size to the large VV poly(A) polymerase subunit (VP55). However, unlike any other poxvirus (Afonso et al. [2000] supra; Afonso et al. [1999] supra; Cameron et al. [1999] supra; Willer et al. [1999] supra; Senkevich et al. [1997] supra; Antoine et al. [1998] supra; Goebel et al. [1990] supra), sequencing suggests that AmEPV may encode two small subunits (AMV060 and AMV115). The two small subunits are somewhat smaller than the 333 amino acid VV small subunit (295 and 293 amino acids respectively) (FIG. 10) and related throughout their length.

Comparison of both AMV060 and AMV115 to the small subunit of VV (VP39, ORF J3R), MsEPV (MSV041) and the sole poly(A) polymerase subunit revealed in the incompletely sequenced genome of HaEPV, is striking (FIG. 10). Both AmEPV small subunits show the largest degrees of relatedness to other poxvirus poly(A) polymerase small subunits within the first 200 amino acids. Both AmEPV small subunits contain a highly conserved poly(A) polymerase regulatory structural motif encompassing amino acids 1–281 within AMV060 and amino acids 8–271 within AMV115. The AMV060 subunit is more related to VP39 than is AMV115. However, if both the two AmEPV small subunits are both compared to the single poly(A) polymerase small subunit of MsEPV (MSV041), the homologies for both AMV60 and AMV115 to MSV041 comparable and greater than either of the small AmEPV subunits to VV. BLAST values for AMV060 showed it to be most related to the small poly(A) polymerase subunit sequenced from HaEPV (Sriskantha et al. [1997] supra), while AMV115 was most homologous to that of MsEPV.

One highly conserved, ungapped motif (FIG. 10) [L/V]-Y-1-G-S-X-X-[G/A]-[Y/T]-H-X-X-X-L can be somewhat expanded if comparisons are limited to only EPV sequences. Note that there are other completely conserved residues in the centermost region of the proteins, and many other conservative substitutions.

Another interesting feature is revealed when one examines the C-terminus of the small subunits (FIG. 10). One immediately notes that the comparable VV small subunit contains a C-terminal extension. The VV 36–43 amino acid C-terminal tail is non-essential for activity (Shi, X., Yao, P., Jose, T., and Gershon, P. [1996] "Methyltransferase-specific domains within VP-39, a bifunctional protein that participates in the modification of both mRNA ends" RNA 2:88–101), and is probably retained because the C-terminal region of the VV subunit overlaps the next open reading frame (J4R) which encodes a 22 kDa subunit of the VV RNA polymerase (Goebel et al. [1990] supra).

One functional hypothesis to account for the presence of an additional small poly(A) subunit is suggested by the multiple activities of the poly(A) polymerase itself (Gershon, P. D., Shi, X. N., and Hodel, A. E. [1998] "Evidence that the RNA methylation and poly(A) polymerase stimulatory activities of vaccinia virus protein VP39 do not impinge upon one another" Virology 246:253–265). VV VP55 catalyzes the initial (~35 base) addition of 3' poly(A) to newly synthesized mRNA or 5' phosphorylated nucleotide primers (Gershon, P. D., Ahn, B. Y., Garfield, M., and Moss, B. [1991] "Poly(A) polymerase and a dissociable polyadenylation stimulatory factor encoded by vaccinia virus" Cell 66:1269–1278). The small subunit, VP39 has three activities. The first is to serve as a processivity factor which in the presence of VP55 extends the poly(A) length to several hundred A residues (Gershon, P. D. and Moss, B. [1993] "Stimulation of poly(A) tail elongation by the VP39 subunit of the vaccinia virus-encoded poly(A) polymerase" J. Biol. Chem. 268:2203–2210). The second, distinct activity, mediated by VP39 alone, is an mRNA cap-specific 2'-O-methyltransferase (Schnierle et al. [1992] supra). The third activity is an associated transcription elongation factor (Latner, D. R., Xiang, Y., Lewis, J. I., Condit, J., and Condit, R. C. [2000] "The vaccinia virus bifunctional gene J3 (nucleoside-2'-O-)-methyltransferase and poly(A) polymerase stimulatory factor is implicated as a positive transcription elongation factor by two genetic approaches" Virology 269:345–355). It is possible that these various activities have been distributed amongst the two subunits. Alternatively, one of the subunits may have evolved to fulfill an entirely unrelated function.

AMV050 (SEQ ID NO: 7) and AMV210 (SEQ ID NO: 8) encode AmEPV DNA polymerases. In view of our findings with the poly(A) polymerase, we would like to call attention to an interesting feature of EPV DNA polymerases first noted in African Swine Fever virus (Oliveros, M., Yanez, R. J., Salas, M. L., Salas, J., Vinuela, E., and Blanco, L. [1997] "Characterization of an African swine fever virus 20-kDa DNA polymerase involved in DNA repair" J. Biol. Chem. 272:30899–30910) and later in MsEPV (Afonso et al. [1999] supra), which has also been found in AmEPV. The 1105 residue AmEPV ORF AMV050 is similar in length, and homologous to typical poxvirus encoded DNA polymerases. A second smaller (612 amino acids) AmEPV encoded ORF. AMV210, shares a 460 amino acid region of clear homology with AMV050, although both proteins possess completely unique regions; i.e., the N-terminus of AMV050 (residues 1–645) and C-terminus of AMV210 (residues 463–612). Both proteins have been found to contain DNA polymerase motifs (Table 1).

AMV130 (SEQ ID NO: 9) encodes an AmEPV ABC transporter-like protein. AMV130 represents the largest ORF in AmEPV. The 1384 residue protein shows homology to the ATP-binding cassette (ABC) proteins. These are a large gene family found from bacteria to man, and have a variety of functions (van Veen, H. W. and Konings, W. N. [1998] "Structure and function of multidrug transporters" *Adv. Exp. Med. Biol.* 456:145–158). While most are ATP-driven membrane translocators, some act as ion channels, ion channel regulators, receptors, proteases, immune regulators and even sensing proteins (Bauer, B. E., Wolfger, H., and Kuchler, K. [1999] "Inventory and function of yeast ABC proteins: about sex, stress, pleiotropic drug and heavy metal resistance" *Biochim. Biophys. Acta* 1461:217–236; Klein, I., Sarkadi, B., and Radi, A. [1999] "An inventory of the human ABC proteins" *Biochim. Biophys. Acta* 1461:237–262; Abele, R. and Tampe, R. [1999] "Function of the transport complex TAP in cellular immune recognition" *Biochim. Biophys. Acta* 1461:405–419). All ABC proteins share a common molecular architecture consisting of at least one 200–250 amino acid ABC cassette and several predicted α-helical membrane spanning segments (TMS or TMD). The minimum structural requirement is considered to be 2 ABC and 2 TMD regions, present in either 1 (full transporter) or 2 (half transporter) polypeptide chains. The AmEPV ABC protein consists of TMD-ABC-TMD-ABC domains, one of the structures of active ABC transporters. This arrangement of AMV130 domains is also found in the MDR/TAP, MRP, CFTR and ABC1 subfamilies and is associated with activities ranging from control of sex (yeast), drug resistance (humans, bacteria), ion channels (human CFTR gene) and engulfment of dead cells (*C. elegans*) (Bauer et al. [1999] supra; Klein et al. [1999] supra; Abele and Tampe [1999] supra). Each AmEPV TMD contains 6 or 7 transmembrane helices (FIG. 11). No other virus is known to encode an ABC transporter. The potential ABC-transporter encoded by AmEPV may play a role in evading host immune defenses, e.g. facilitating removal of toxic elements from virally infected cells.

AMV007 (SEQ ID NO: 10) encodes an AmEPV Kunitz-motif protease inhibitor (KPI). AmEPV ORF AMV007 is located near the left end of the AmEPV genome, and encodes a small protein of 79 amino acids. A Prosite search revealed the presence of a Kunitz family signature (Prosite PS00280), a motif associated with protease inhibitors (FIG. 12). Indeed, the Kunitz-type pancreatic trypsin inhibitors represent one of the most common families of serine protease inhibitors. Kunitz-type inhibitors found within insects are typically less than 100 amino acids in length. All contain certain five invariant cysteine residues. AMV007 has all five cysteines and the alignment allows prediction of an arginine P1. The inducible serine protease inhibitor (ISP-2) of *Galleria mellonella* (Frobius, A. C., Kanost, M. R., Gotz, P., and Vileinskas, A. [2000] "Isolation and characterization of novel inducible serine protease inhibitors from larval hemolymph of the greater wax moth Galleria mellonella" *Eur. J. Biochem.* 267:2046–2053) and the hemolymph trypsin inhibitors (HLTIs A and B) of *Manduca sexta* (Ramesh, N., Sugumaran, M., and Mole, J. E. [1988] "Purification and characterization of two trypsin inhibitors from the hemolymph of *Manduca sexta* larvae" *J. Biol. Chem.* 263:11523–11527) are both Kunitz-type inhibitors that contain P1 residues of arginine, and inhibit trypsin-like proteases. Structurally, Kunitz-type inhibitors are comprised of short alpha/beta proteins with little secondary structure. Although widespread in nature, there are no reports of the presence of a Kunitz-type protease inhibitor (KPI) from this family in any viral genome. It is interesting to note that vertebrate poxviruses do encode protease inhibitors, but they are members of a different family (the serine protease inhibitor, serpin) family. The vertebrate poxvirus serpins have been shown to have an immunoregulatory role in the infected vertebrate host (Turner, S., Kenshole, B., and Ruby, J. [1999] "Viral modulation of the host response via crmA/SPI-2 expression" *Immunology and Cell Biology* 77:236–241; McFadden, G. [1995] In: *Viroceptors, virokines and related immune modulators encoded by DNA viruses*, R. G. Landes/Springer-Verlag, Austin, Tex.; McFadden, G., Graham, K., and Barry, M. [1996] "New Strategies of immune modulation by DNA viruses" *Transplant. Proc.* 28:2085–2088). We propose that the AmEPV KPI protein may fulfill a similar immunoregulatory role in the infected invertebrate host, but may target different pathways than do the serpins which control inflamnation, apoptosis and the host immune response (Turner and Moyer [1998] supra; Turner, P. C., Musy, P. Y., and Moyer, R. W. [1995] Poxvirus Serpins. In "Viroceptors, Virokines and related immune modulators encoded by DNA viruses," G. McFadden, ed., pp. 67–88. R. G. Landes, Galveston, Tex.).

One function the KPI protein may possess is suggested by the physiology of the insect host. The haemolymph of insects contains relatively high concentrations of a variety of protease inhibitors from several different gene families (Kanost, M. R. [1999] "Serine proteinase inhibitors in arthropod immunity" *Developmental and Comparative Immunology* 23:291–301: Jiang, H. B, and Kanost, M. R. [1997] "Characterization and functional analysis of 12 naturally occurring reactive site variants of serpin-1 from *Manduca sexta*" *J. Biol. Chem.* 272:1082–1087). Protease inhibitors from the Kunitz family have been identified as haemolymph proteins from lepidopteran insect species (Sugumaran, M., Saul, S. J., and Ramesh, N. [1985] "Endogenous protease inhibitors prevent undesired activation of prophenolase in insect hemolymph" *Biochem. Biophys. Res. Commun.* 132:1124–1129; Sasaki, T. [1984] "Amino acid sequence of a novel Kunitz-type chymotrysin inhibitor from hemolymph of silkworm larvae" *Bombyx moori. FEBS Lett.* 168:230), which function as inhibitors of trypsin or chymotrypsin. These host KPI proteins have been shown to be important in the avoidance of inopportune chymotrypsin-mediated activation of prophenyloxidase (Saul, S. J. and Sugumaran, M. [1986] "Protease inhibitor controls prophenoloxidase activation in *Manduca sexta*" *FEBS Lett.* 208:113–116; Aso, Y., Yamashita, T., Meno. K., and Murakami, M. [1994] "Inhibition of prophenoloxidase-activating enzyme from *Bombyx mori* by endogenous chymotrypsin inhibitors" *Biochem. Mol. Biol Int.* 33:751–758). This enzyme is an early component of the cascade required by the insect immune system to produce melanin, which is used to engulf and overcome invading foreign objects (Gillespie, J. P., Kanost, M. R., and Trenczek, T. [1997] "Biological mediators of insect immunity" *Annu. Rev. Entomol.* 42:611–43, 611–643; Vilmos, P. and Kuruez, E. [1998] "Insect immunity: evolutionary roots of the mammalian innate immune system" *Immunol. Lett.* 62:59–66). Production of such a protein by an infecting virus may therefore lessen the amount of prophenyloxidase induced by the insect immune system during infection.

Polynucleotides of the subject invention include sequences identified in the attached sequence listing as well as the tables and figures and described by open reading frame (ORF) position within the genome. In addition, the subject invention includes polynucleotides which hybridize with other polynucleotides of the subject invention.

Additional Uses of Polynucleotides

The polynucleotide sequences exemplified herein can be used in a variety of ways, having numerous applications in techniques known to those skilled in the art of molecular biology having the instant disclosure. These techniques include their use as hybridization probes, for chromosome and gene mapping, in PCR technologies, and in the production of sense or antisense nucleic acids.

These polynucleotides can be used in assays for additional polynucleotides and additional homologous genes, and can be used in tracking the quantitative and temporal expression of these genes in cells and organisms. Polynucleotides of the subject invention may be used as insertion sites for foreign genes of interest.

Antisense technology can also be used to interfere with expression of the disclosed polynucleotides. For example, the transformation of a cell or organism with the reverse complement of a gene encoded by a polynucleotide exemplified herein can result in strand co-suppression and silencing or inhibition of a target gene, e.g., one involved in the infection process.

Polynucleotides disclosed herein are useful as target genes for the synthesis of antisense RNA or dsRNA useful for RNA-mediated gene interference. The ability to specifically inhibit gene function in a variety of organisms utilizing antisense RNA or ds RNA-mediated interference is well known in the fields of molecular biology (see for example C. P. Hunter, Current Biology [1999] 9:R440–442; Hamilton et al., [1999] Science, 286:950–952; and S. W. Ding, Current Opinions in Biotechnology [2000] 11:152–156, hereby incorporated by reference in their entireties). dsRNA (RNAi) typically comprises a polynucleotide sequence identical or homologous to a target gene (or fragment thereof) linked directly, or indirectly, to a polynucleotide sequence complementary to the sequence of the target gene (or fragment thereof). The dsRNA may comprise a polynucleotide linker sequence of sufficient length to allow for the two polynucleotide sequences to fold over and hybridize to each other, however, a linker sequence is not necessary. The linker sequence is designed to separate the antisense and sense strands of RNAi significantly enough to limit the effects of steric hindrances and allow for the formation of dsRNA molecules and should not hybridize with sequences within the hybridizing portions of the dsRNA molecule. The specificity of this gene silencing mechanism appears to be extremely high, blocking expression only of targeted genes while leaving other genes unaffected. Accordingly, one method for controlling gene expression according to the subject invention provides materials and methods using double-stranded interfering RNA (dsRNAi), or RNA-mediated interference (RNAi). The terms dsRNAi and RNAi are used interchangeably herein unless otherwise noted.

RNA containing a nucleotide sequence identical to a fragment of the target gene is preferred for inhibition; however, RNA sequences with insertions, deletions, and point mutations relative to the target sequence can also be used for inhibition. Sequence identity may optimized by sequence comparison and alignment algorithms known in the art (see Gribskov and Devereux, *Sequence Analysis Primer*, Stockton Press, 1991, and references cited therein) and calculating the percent difference between the nucleotide sequences by, for example, the Smith-Waterman algorithm as implemented in the BESTFIT software program using default parameters (e.g. University of Wisconsin Genetic Computing Group). Alternatively, the duplex region of the RNA may be defined functionally as a nucleotide sequence that is capable of hybridizing with a fragment of the target gene transcript.

RNA may be synthesized either in vivo or in vitro. Endogenous RNA polymerase of the cell may mediate transcription in vivo, or cloned RNA polymerase can be used for transcription in vivo or in vitro. For transcription from a transgene in vivo or an expression construct, a regulatory region (e.g., promoter, enhancer, silencer, splice donor and acceptor, polyadenylation) may be used to transcribe the RNA strand (or strands): the promoters may be known inducible promoters such as baculovirus. Inhibition may be targeted by specific transcription in an organ, tissue, or cell type. The RNA strands may or may not be polyadenylated; the RNA strands may or may not be capable of being translated into a polypeptide by a cell's translational apparatus. RNA may be chemically or enzymatically synthesized by manual or automated reactions. The RNA may be synthesized by a cellular RNA polymerase or a bacteriophage RNA polymerase (e.g., T3, T7, SP6). The use and production of an expression construct are known in the art (see, for example, WO 97/32016; U.S. Pat. Nos. 5,593,874; 5,698,425; 5,712,135; 5,789,214; and 5,804,693; and the references cited therein). If synthesized chemically or by in vitro enzymatic synthesis, the RNA may be purified prior to introduction into the cell. For example, RNA can be purified from a mixture by extraction with a solvent or resin, precipitation, electrophoresis, chromatography, or a combination thereof. Alternatively, the RNA may be used with no or a minimum of purification to avoid losses due to sample processing. The RNA may be dried for storage or dissolved in an aqueous solution. The solution may contain buffers or salts to promote annealing, and/or stabilization of the duplex strands.

Preferably and most conveniently, dsRNAi can be targeted to an entire polynucleotide sequence set forth herein. Preferred RNAi molecules of the instant invention are highly homologous or identical to the polynucleotides of the sequence listing. The homology may be greater than 70%, preferably greater than 80%, more preferably greater than 90% and is most preferably greater than 95%.

Fragments of genes can also be utilized for targeted suppression of gene expression. These fragments are typically in the approximate size range of about 20 nucleotides. Thus, targeted fragments are preferably at least about 15 nucleotides. In certain embodiments, the gene fragment targeted by the RNAi molecule is about 20–25 nucleotides in length. In a more preferred embodiment, the gene fragments are at least about 25 nucleotides in length. In an even more preferred embodiment, the gene fragments are at least 50 nucleotides in length.

Thus, RNAi molecules of the subject invention are not limited to those that are targeted to the full-length polynucleotide or gene. Gene product can be inhibited with a RNAi molecule that is targeted to a portion or fragment of the exemplified polynucleotides; high homology (90–95%) or greater identity is also preferred, but not necessarily essential, for such applications.

In another aspect of the invention, the dsRNA molecules of the invention may be introduced into cells with single stranded (ss) RNA molecules which are sense or anti-sense RNA derived from the nucleotide sequences disclosed herein. Methods of introducing ssRNA and dsRNA molecules into cells are well-known to the skilled artisan and includes transcription of plasmids, vectors, or genetic constructs encoding the ssRNA or dsRNA molecules according to this aspect of the invention; electroporation, biolistics, or other well-known methods of introducing nucleic acids into cells may also be used to introduce the ssRNA and dsRNA molecules of this invention into cells.

Other aspects of the invention include use of the disclosed sequences or recombinant nucleic acids derived therefrom to produce purified peptides. The nucleotide sequences as disclosed herein may be used to produce an amino acid sequence using well known methods of recombinant DNA technology. Goeddel (Gene Expression Technology, Methods and Enzymology [1990] Vol 185, Academic Press, San Diego, Calif.) is one among many publications which teach expression of an isolated, purified nucleotide sequence. The amino acid or peptide may be expressed in a variety of host cells, either prokaryotic or eukaryotic. Host cells may be from the same species from which the nucleotide sequence was derived or from a different species.

Still further aspects of the invention use these purified peptides to produce antibodies or other molecules able to bind to the peptides. These antibodies or binding agents can then be used for the screening of cells in order to localize the cellular distribution of the peptides or proteins. The antibodies are also useful for the affinity purification of recombinantly produced peptides or proteins.

The disclosed nucleotide sequences can be used individually, or in panels, in tests or assays to detect levels of peptide, polypeptide, or protein expression. The form of such qualitative or quantitative methods may include northern analysis, dot blot or other membrane based technologies, dip stick, pin or chip technologies, PCR, ELISAs or other multiple sample format technologies.

The subject invention also provides polynucleotides identified as control elements or regulatory sequences, such as gene promoters, enhancers, introns and untranslated regions which interact with cellular components to carry out regulatory functions such as replication, transcription, and translation. The invention further comprises the use of the disclosed polynucleotide sequences, or fragments thereof, in assays to characterize and/or identify sequences having promoter or other regulatory activity. Also contemplated according to the subject invention is the use of oligomers from these sequences in kits which can be used to identify promoters or other regulatory sequences.

As used herein, the following definitions apply:

An "oligonucleotide" or "oligomer" is a stretch of nucleotide residues which has a sufficient number of bases to be used in a polymerase chain reaction (PCR). These short sequences are based on (or designed from) genomic or cDNA sequences and are used to amplify, confirm, or reveal the presence of an identical, similar or complementary DNA or RNA in a particular cell or tissue. Oligonucleotides or oligomers comprise portions of a DNA sequence having at least about 10 nucleotides and as many as about 50 nucleotides, preferably about 15 to 30 nucleotides. They can be chemically synthesized and may he used as probes.

"Probes" are nucleic acid sequences of variable length, preferably between at least about 10 and as many as about 6,000 nucleotides, depending on use. They are used in the detection of identical, similar, or complementary nucleic acid sequences. Longer length probes are usually obtained from a natural or recombinant source, are highly specific and much slower to hybridize than oligomers. They may be single- or double-stranded and designed to have specificity in PCR, hybridization membrane-based, or ELISA-like technologies.

"Reporter" molecules are chemical moieties used for labeling a nucleic or amino acid sequence. They include, but are not limited to, radionuclides, enzymes, fluorescent, chemi-luminescent, or chromogenic agents. Reporter molecules associate Keith, establish the presence of, and may allow quantification of a particular nucleic or amino acid sequence.

A "portion" or "fragment" of a polynucleotide or nucleic acid comprises all or any part of the nucleotide sequence having fewer nucleotides than about 6 kb, preferably fewer than about 1 kb which can be used as a probe. Such probes may be labeled with reporter molecules using nick translation, Klenow fill-in reaction. PCR or other methods well known in the art. After pretesting to optimize reaction conditions and to eliminate false positives, nucleic acid probes may be used in Southern, northern or in situ hybridizations to determine whether target DNA or RNA is present in a biological sample, cell type, tissue, organ or organism.

"Recombinant nucleotide variants" are alternate polynucleotides which encode a particular protein. They may be synthesized, for example, by making use of the "redundancy" in the genetic code. Various codon substitutions, such as the silent changes which produce specific restriction sites or codon usage-specific mutations, may be introduced to optimize cloning into a plasmid or viral vector or expression in a particular prokaryotic or eukaryotic host system, respectively.

"Linkers" are synthesized palindromic nucleotide sequences which create internal restriction endonuclease sites for ease of cloning the genetic material of choice into various vectors. "Polylinkers" are engineered to include multiple restriction enzyme sites and provide for the use of both those enzymes which leave 5' and 3' overhangs such as BamHI, EcoRI, PstI, KpnI and Hind III or which provide a blunt end such as EcoRV, SnaBI and StuI.

"Control elements" or "regulatory sequences" are regions of the gene or DNA such as enhancers, promoters, introns and 3' untranslated regions which interact with cellular proteins to carry out replication, transcription, and translation. Typically, these regions are nontranslated. They may occur as boundary sequences or even split the gene. They function at the molecular level and along with regulatory genes are very important in development, growth, differentiation and aging processes.

"Chimeric" molecules are polynucleotides or polypeptides which are created by combining one or more nucleotide peptide sequences (or their parts). In the case of nucleotide sequences, such combined sequences may be introduced into an appropriate vector and expressed to give rise to a chimeric polypeptide which may be expected to be different from the native molecule in one or more of the following characteristics: cellular location, distribution, ligand-binding affinities, interchain affinities, degradation/turnover rate, signaling, etc.

"Active" is that state which is capable of being useful or of carrying out some role. It specifically refers to those forms, fragments, or domains of an amino acid sequence which display the biologic and/or immunogenic activity characteristic of the naturally occurring peptide, polypeptide, or protein.

"Naturally occurring" refers to a polypeptide produced by cells which have not been genetically engineered or which have been genetically engineered to produce the same sequence as that naturally produced.

"Derivative" refers to those polypeptides which have been chemically modified by such techniques as ubiquitination, labeling, pegylation (derivatization with polyethylene glycol), and chemical insertion or substitution of amino acids such as ornithine which do not normally occur in proteins.

"Recombinant polypeptide variant" refers to any polypeptide which differs from naturally occurring peptide, polypeptide, or protein by amino acid insertions, deletions and/or substitutions.

Amino acid "substitutions" are defined as one for one amino acid replacements. They are conservative in nature when the substituted amino acid has similar structural and/or chemical properties. Examples of conservative replacements are substitution of a leucine with an isoleucine or valine, an aspartate with a glutamate, or a threonine with a serine.

Amino acid "insertions" or "deletions" are changes to or within an amino acid sequence. They typically fall in the range of about 1 to 5 amino acids. The variation allowed in a particular amino acid sequence may be experimentally determined by producing the peptide synthetically or by systematically making insertions, deletions, or substitutions of nucleotides in the sequence using recombinant DNA techniques.

A "signal or leader sequence" is a short amino acid sequence which can be used, when desired, to direct the polypeptide through a membrane of a cell. Such a sequence may be naturally present on the polypeptides of the present invention or provided from heterologous sources by recombinant DNA techniques. Such sequences include nuclear localization sequences (NLS) known in the art.

An "oligopeptide" is a short stretch of amino acid residues and may be expressed from an oligonucleotide. Such sequences comprise a stretch of amino acid residues of at least about 5 amino acids and often about 17 or more amino acids, typically at least about 9 to 13 amino acids, and of sufficient length to display biologic and/or immunogenic activity.

An "inhibitor" is a substance which retards or prevents a chemical or physiological reaction or response. Common inhibitors include but are not limited to antisense molecules, antibodies, antagonists and their derivatives.

A "standard" is a quantitative or qualitative measurement for comparison. Preferably, it is based on a statistically appropriate number of samples and is created to use as a basis of comparison when performing diagnostic assays, running clinical trials, or following patient treatment profiles. The samples of a particular standard may be normal or similarly abnormal.

Since the list of technical and scientific terms cannot be all encompassing, any undefined terms shall be construed to have the same meaning as is commonly understood by one of skill in the art to which this invention belongs. Furthermore, the singular forms "a", "an" and "the" include plural referents unless the context clearly dictates otherwise.

The invention is not to be limited only to the particular sequences, variants, formulations or methods described. The sequences, variants, formulations and methodologies may vary, and the terminology used herein is for the purpose of describing particular embodiments. The terminology and definitions are not intended to be limiting.

Polynucleotide probes

DNA possesses a fundamental property called base complementarity. In nature, DNA ordinarily exists in the form of pairs of anti-parallel strands, the bases on each strand projecting from that strand toward the opposite strand. The base adenine (A) on one strand will always be opposed to the base thymine (T) on the other strand, and the base guanine (G) will be opposed to the base cytosine (C). The bases are held in apposition by their ability to hydrogen bond in this specific way. Though each individual bond is relatively weak, the net effect of many adjacent hydrogen bonded bases, together with base stacking effects, is a stable joining of the two complementary strands. These bonds can be broken by treatments such as high pH or high temperature, and these conditions result in the dissociation, or "denaturation," of the two strands. If the DNA is then placed in conditions which make hydrogen bonding of the bases thermodynamically favorable, the DNA strands will anneal, or "hybridize," and reform the original double-stranded DNA. If carried out under appropriate conditions, this hybridization can be highly specific. That is, only strands with a high degree of base complementarity will be able to form stable double-stranded structures. The relationship of the specificity of hybridization to reaction conditions is well known. Thus, hybridization may be used to test whether two pieces of DNA are complementary in their base sequences. It is this hybridization mechanism which facilitates the use of probes of the subject invention to readily detect and characterize DNA sequences of interest.

The polynucleotides of the subject invention can themselves be used as probes. Additional polynucleotide sequences can be added to the ends of (or internally in) the exemplified polynucleotide sequences so that polynucleotides that are longer than the exemplified polynucleotides can also be used as probes. Thus, isolated polynucleotides comprising one or more of the exemplified sequences are within the scope of the subject invention. Polynucleotides that have less nucleotides than the exemplified polynucleotides can also be used and are contemplated within the scope of the present invention. For example, for some purposes, it might be useful to use a conserved sequence from an exemplified polynucleotide wherein the conserved sequence comprises a portion of an exemplified sequence. Thus, polynucleotides of the subject invention can be used to find additional, homologous (wholly or partially) genes. Hybridization probes of the subject invention may be derived from the open reading frames specifically exemplified in the sequence listing, figures, and tables as well as from surrounding or included genomic sequences comprising untranslated regions such as promoters, enhancers and introns.

Probes of the subject invention may be composed of DNA, RNA, or PNA (peptide nucleic acid). The probe will normally have at least about 10 bases, more usually at least about 17 bases, and may have up to about 100 bases or more. Longer probes can readily be utilized, and such probes can be, for example, several kilobases in length. The probe sequence is designed to be at least substantially complementary to a portion of a gene encoding a protein of interest. The probe need not have perfect complementarity to the sequence to which it hybridizes. The probes may be labeled utilizing techniques that are well known to those skilled in this art.

One approach for the use of the subject invention as probes entails first identifying DNA segments that are homologous with the disclosed nucleotide sequences using, for example. Southern blot analysis of a gene bank. Thus, it is possible, without the aid of biological analysis, to know in advance the probable activity of many new polynucleotides, and of the individual gene products expressed by a given polynucleotide. Such an analysis provides a rapid method for identifying commercially valuable compositions.

One hybridization procedure useful according to the subject invention typically includes the initial steps of isolating the DNA sample of interest and purifying it chemically. Either lysed cells or total fractionated nucleic acid isolated from cells can be used. Cells can be treated using known techniques to liberate their DNA (and/or RNA). The DNA sample can be cut into pieces with an appropriate restriction enzyme. The pieces can be separated by size through electrophoresisin a gel, usually agarose or acrylamide. The pieces of interest can be transferred to an immobilizing membrane.

The particular hybridization technique is not essential to the subject invention. As improvements are made in hybridization techniques, they can be readily applied.

The probe and sample can then be combined in a hybridization buffer solution and held at an appropriate temperature until annealing occurs. Thereafter, the membrane is washed free of extraneous materials, leaving the sample and bound probe molecules typically detected and quantified by autoradiography and/or liquid scintillation counting. As is well known in the art, if the probe molecule and nucleic acid sample hybridize by forming a strong non-covalent bond between the two molecules, it can be reasonably assumed that the probe and sample are essentially identical or very similar. The probe's detectable label provides a means for determining in a known manner whether hybridization has occurred.

In the use of the nucleotide segments as probes, the particular probe is labeled with any suitable label known to those skilled in the art, including radioactive and non-radioactive labels. Typical radioactive labels include $^{32}$P, $^{35}$S, or the like. Non-radioactive labels include, for example, ligands such as biotin or thyroxine, as well as enzymes such as hydrolases or peroxidases, or the various chemiluminescers such as luciferin, or fluorescent compounds like fluorescein and its derivatives. In addition, the probes can be made inherently fluorescent as described in International Application No. WO 93/16094.

Various degrees of stringency of hybridization can be employed. The more stringent the conditions, the greater the complementarity that is required for duplex formation. Stringency can be controlled by temperature, probe concentration, probe length, ionic strength, time, and the like. Preferably, hybridization is conducted under moderate to high stringency conditions by techniques well known in the art, as described, for example, in Keller, G. H., M. M. Manak (1987) *DNA Probes*, Stockton Press, New York, N.Y., pp. 169–170.

As used herein "moderate to high stringency" conditions for hybridization refers to conditions that achieve the same, or about the same, degree of specificity of hybridization as the conditions as described herein." Examples of moderate to high stringency conditions are provided herein. Specifically, hybridization of immobilized DNA on Southern blots with $^{32}$P-labeled gene-specific probes was performed using standard methods (Maniatis et al.). In general, hybridization and subsequent washes were carried out under moderate to high stringency conditions that allowed for detection of target sequences with homology to sequences exemplified herein. For double-stranded DNA gene probes, hybridization was carried out overnight at 20–25° C. below the melting temperature (Tm) of the DNA hybrid in 6×SSPE, 5×Denhardt's solution, 0.1% SDS, 0.1 mg/ml denatured DNA. The melting temperature is described by the following formula from Beltz et al. (1983):

Tm=81.5° C.+16.6 Log[Na+]+0.41(% G+C)−0.61(% formamide)−600/length of duplex in base pairs.

Washes are typically carried out as follows:

(1) Twice at room temperature for 15 minutes in 1×SSPE, 0.1% SDS (low stringency wash).

(2) Once at Tm−20° C. for 15 minutes in 0.2×SSPE, 0.1% SDS (moderate stringency wash).

For oligonucleotide probes, hybridization was carried out overnight at 10–20° C. below the melting temperature (Tm) of the hybrid in 6×SSPE, 5×Denhardt's solution, 0.1% SDS, 0.1 mg/ml denatured DNA. Tm for oligonucleotide probes was determined by the following formula from Suggs et al. (1981):

Tm (° C.)=2(number T/A base pairs)+4(number G/C base pairs)

Washes were typically carried out as follows:

(1) Twice at room temperature for 15 minutes 1×SSPE, 0.1% SDS (low stringency wash).

(2) Once at the hybridization temperature for 15 minutes in 1×SSPE, 0.1% SDS (moderate stringency wash).

In general, salt and/or temperature can be altered to change stringency. With a labeled DNA fragment of greater than about 70 or so bases in length, the following conditions can be used:

Low: 1 or 2×SSPE, room temperature
Low: 1 or 2×SSPE, 42° C.
Moderate: 0.2× or 1×SSPE, 65° C.
High: 0.1×SSPE, 65° C.

Duplex formation and stability depend on substantial complementarity between the two strands of a hybrid, and, as noted above, a certain degree of mismatch can be tolerated. Therefore, polynucleotide sequences of the subject invention include mutations (both single and multiple), deletions, and insertions in the described sequences, and combinations thereof, wherein said mutations, insertions, and deletions permit formation of stable hybrids with a target polynucleotide of interest. Mutations, insertions, and deletions can be produced in a given polynucleotide sequence using standard methods known in the art. Other methods may become known in the future.

The mutational, insertional, and deletional variants of the polypeptide sequences of the invention can be used in the same manner as the exemplified polynucleotide sequences so long as the variants have substantial sequence similarity with the original sequence. As used herein, substantial sequence similarity refers to the extent of nucleotide similarity that is sufficient to enable the variant polynucleotide to function in the same capacity as the original sequence. Preferably, this similarity is greater than 50%; more preferably, this similarity is greater than 75%; and most preferably, this similarity is greater than 90%. The degree of similarity needed for the variant to function in its intended capacity will depend upon the intended use of the sequence. It is well within the skill of a person trained in this art to make mutational, insertional and deletional mutations that are designed to improve the function of the sequence or otherwise provide a methodological advantage.

In one embodiment, the genes of the subject invention have at least one of the following characteristics:

said gene is encoded by a nucleotide sequence which hybridizes under stringent conditions with a nucleotide sequence selected from the group consisting of: DNA which encodes SEQ ID NO: 1, DNA which encodes SEQ ID NO: 2, DNA which encodes SEQ ID NO: 3, DNA which encodes SEQ ID NO: 4, DNA which encodes SEQ ID NO: 5 or SEQ ID NO: 6, DNA which encodes SEQ ID NO: 7 or SEQ ID NO: 8, DNA which encodes SEQ ID NO: 9, DNA which encodes SEQ ID NO: 10, and DNA which encodes SEQ ID NO: 11.

The subject invention also includes polynucleotides that hybridize with other polynucleotides of the subject invention.

PCR Technology

Polymerase Chain Reaction (PCR) is a repetitive, enzymatic, primed synthesis of a nucleic acid sequence. This procedure is well known and commonly used by those skilled in this art (see U.S. Pat. Nos. 4,683,195, 4,683,202, and 4,800,159; Saiki et al., 1985). PCR is based on the enzymatic amplification of a DNA fragment of interest that is flanked by two oligonucleotide primers that hybridize to opposite strands of the target sequence. The primers are oriented with the 3' ends pointing towards each other. Repeated cycles of heat denaturation of the template, annealing of the primers to their complementary sequences, and extension of the annealed primers with a DNA polymerase result in the amplification of the segment defined by the 5' ends of the PCR primers. Since the extension product of each primer can serve as a template for the other primer, each cycle essentially doubles the amount of DNA fragment produced in the previous cycle. This results in the exponential accumulation of the specific target fragment, up to several million-fold in a few hours. By using a thermostable DNA polymerase such as Taq polymerase, which is isolated from the thermophilic bacterium *Thermus aquaticus*, the amplification process can be completely automated. Other enzymes that can be used are known to those skilled in the art.

The polynucleotide sequences of the subject invention (and portions thereof such as conserved regions and portions that serve to distinguish these sequences from previously-known sequences) can be used as, and/or used in the design of, primers for PCR amplification. In performing PCR amplification, a certain degree of mismatch can be tolerated between primer and template. Therefore, mutations, deletions, and insertions (especially additions of nucleotides to the 5' end) of the exemplified polynucleotides can be used in this manner. Mutations, insertions and deletions can be produced in a given primer by methods known to an ordinarily skilled artisan.

Full length genes may be cloned utilizing partial nucleotide sequence and various methods known in the art. Gobinda et al. (1993; *PCR Methods Applic* 2:318–22) disclose "restriction-site PCR" as a direct method which uses universal primers to retrieve unknown sequence adjacent to a known locus. First, genomic DNA is amplified in the presence of primer to linker and a primer specific to the known region. The amplified sequences are subjected to a second round of PCR with the same linker primer and another specific primer internal to the first one. Products of each round of PCR are transcribed with an appropriate RNA polymerase and sequenced using reverse transcriptase.

Inverse PCR can be used to acquire unknown sequences starting with primers based on a known region (Triglia T. et al. (1988) *Nucleic Acids Res* 16:8186). The method uses several restriction enzymes to generate a suitable fragment in the known region of a gene. The fragment is then circularized by intramolecular ligation and used as a PCR template. Divergent primers are designed from the known region. The multiple rounds of restriction enzyme digestions and ligations that are necessary prior to PCR make the procedure slow and expensive (Gobinda et al. [1993] supra).

Capture PCR (Lagerstrom M. et al. (1991) *PCR Methods Applic* 1:111–19) is a method for PCR amplification of DNA fragments adjacent to a known sequence in eucaryotic and YAC DNA. As noted by Gobinda et al. (1993 supra), capture PCR also requires multiple restriction enzyme digestions and ligations to place an engineered double-stranded sequence into an unknown portion of the DNA molecule before PCR. Although the restriction and ligation reactions are carried out simultaneously, the requirements for extension, immobilization and two rounds of PCR and purification prior to sequencing render the method cumbersome and time consuming.

Parker J. D, et al. (*Nucleic Acids Res* [1991] 19:3055–60), teach walking PCR, a method for targeted gene walking which permits retrieval of unknown sequences. Promoter-Finder™ is a kit available from Clontech Laboratories. Inc. (Palo Alto, Calif.) which uses PCR and primers derived from p53 to walk in genomic DNA. Nested primers and special PromoterFinder™ libraries are used to detect upstream sequences such as promoters and regulatory elements. This process avoids the need to screen libraries and is useful in finding intron/exon junctions.

A new PCR method replaces methods which use labeled probes to screen plasmid libraries and allow one researcher to process only about 3–5 genes in 14–40 days. In the first step, which can be performed in about two days, any two of a plurality of primers are designed and synthesized based on a known partial sequence. In step 2, which takes about six to eight hours, the sequence is extended by PCR amplification of a selected library. Steps 3 and 4, which take about one day, are purification of the amplified cDNA and its ligation into an appropriate vector. Step 5, which takes about one day, involves transforming and growing up host bacteria. In step 6, which takes approximately five hours. PCR is used to screen bacterial clones for extended sequence. The final steps, which take about one day, involve the preparation and sequencing of selected clones.

If the full length cDNA has not been obtained, the entire procedure is repeated using either the original library or some other preferred library. The preferred library may be one that has been size-selected to include only larger cDNAs or may consist of single or combined commercially available libraries, e.g., from Clontech Laboratories, Inc. (Palo Alto, Calif.). The cDNA library may have been prepared with oligo (dT) or random priming. Random primed libraries are preferred in that they will contain more sequences which contain 5' ends of genes. A randomly primed library may be particularly useful if an oligo (dT) library does not yield a complete gene. It must be noted that the larger and more complex the protein, the less likely it is that the complete gene will be found in a single plasmid.

CLONTECH PCR-Select™ cDNA Subtraction (Clontech Laboratories, Inc., Palo Alto, Calif.) is yet another means by which differentially expressed genes may be isolated. The procedure allows for the isolation of transcripts present in one mRNA population which is absent or found in reduced numbers, in a second population of mRNA. Rare transcripts may be enriched 1000-fold.

A new method for analyzing either the size or the nucleotide sequence of PCR products is capillary electrophoresis. Systems for rapid sequencing are available from Perkin Elmer (Foster City Calif.). Beckman Instruments (Fullerton, Calif.), and other companies. Capillary sequencing employs flowable polymers for electrophoretic separation, four different fluorescent dyes (one for each nucleotide) which are laser activated, and detection of the emitted wavelengths by a charge coupled devise camera. Output/light intensity is converted to electrical signal using appropriate software (eg. Genotyper™ and Sequence Navigators™ from Perkin Elmer) and the entire process from loading of samples to computer analysis and electronic data display is computer controlled. Capillary electrophoresis provides greater resolution and is many times faster than standard gel based procedures. It is particularly suited to the sequencing of small pieces of DNA which might be present in limited amounts in a particular sample. The reproducible sequencing of up to 350bp of M13 phage DNA in 30 min has been reported (Ruiz-Martinez M. C. et al. [1993] *Anal Chem* 65:2851–8).

Polynucleotides and Proteins

Polynucleotides of the subject invention can be defined according to several parameters. One characteristic is the biological activity of the protein products as identified herein. The proteins and genes of the subject invention can be further defined by their amino acid and nucleotide sequences. The sequences of the molecules can be defined in terms of homology to certain exemplified sequences as well as in terms of the ability to hybridize with, or be amplified by, certain exemplified probes and primers. Additional primers and probes can readily be constructed by those skilled in the art such that alternate polynucleotide sequences encoding the same amino acid sequences can be used to identify and/or characterize additional genes. The proteins of the subject invention can also be identified based on their immunoreactivity with certain antibodies.

The polynucleotides and proteins or polypeptides of the subject invention include portions, fragments, variants, and mutants of the full-length sequences as well as fusions and chimerics, so long as the encoded protein retains the characteristic biological activity of the proteins identified herein. As used herein, the terms "variants" or "variations" of genes refer to nucleotide sequences that encode the same proteins or which encode equivalent proteins having equivalent biological activity. As used herein, the term "equivalent proteins" refers to proteins having the same or essentially the same biological activity as the exemplified proteins.

Variations of genes may be readily constructed using standard techniques such as site-directed mutagenesis and other methods of making point mutations and by DNA shuffling, for example. In addition, gene and protein fragments can be made using commercially available exonucleases, endonucleases, and proteases according to standard procedures. For example, enzymes such as Bal31 can be used to systematically cut off nucleotides from the ends of genes. Also, genes that encode fragments may be obtained using a variety of restriction enzymes. Proteases may be used to directly obtain active fragments of these proteins. Of course, molecular techniques for cloning polynucleotides and producing gene constructs of interest are also well known in the art. In vitro evaluation techniques, such as MAXYGEN's "Molecular Breeding" can also be applied to practice the subject invention.

Because of the redundancy of the genetic code, a variety of different DNA sequences can encode the amino acid sequences encoded by the polynucleotide sequences disclosed herein. It is well within the skill of a person trained in the art to create these alternative DNA sequences encoding proteins having the same, or essentially the same, amino acid sequence. These variant DNA sequences are within the scope of the subject invention. As used herein, reference to "essentially the same" sequence refers to sequences that have amino acid substitutions, deletions, additions, or insertions that do not materially affect biological activity. Fragments retaining the characteristic biological activity are also included in this definition.

A further method for identifying genes and polynucleotides (and the proteins encoded thereby) of the subject invention is through the use of oligonucleotide probes. Probes provide a rapid method for identifying genes of the subject invention. The nucleotide segments that are used as probes according to the invention can be synthesized using a DNA synthesizer and standard procedures.

The subject invention comprises variant or equivalent proteins (and nucleotide sequences coding for equivalent proteins) having the same or similar biological activity of proteins encoded by the exemplified polynucleotides. Equivalent proteins will have amino acid similarity with an exemplified protein (or peptide). The amino acid identity will typically be greater than 60%. Preferably, the amino acid identity will be greater than 75%. More preferably, the amino acid identity will be greater than 80%, and even more preferably greater than 90%. Most preferably, amino acid identity will be greater than 95%. (Likewise, the polynucleotides that encode the subject polypeptides will also have corresponding identities in these preferred ranges.) These identities are as determined using standard alignment techniques for determining amino acid identity. The amino acid identity/similarity/homology will be highest in critical regions of the protein including those regions that account for biological activity or that are involved in the determination of three-dimensional configuration that is ultimately responsible for the biological activity. In this regard, certain amino acid substitutions are acceptable and can be expected if these substitutions are in regions which are not critical to activity or are conservative amino acid substitutions which do not affect the three-dimensional configuration of the molecule. For example, amino acids may be placed in the following classes: non-polar, uncharged polar, basic, and acidic. Conservative substitutions whereby an amino acid of one class is replaced with another amino acid of the same type fall within the scope of the subject invention so long as the substitution does not materially alter the biological activity of the compound.

Table 4 provides a listing of examples of amino acids belonging to each class.

TABLE 4

| Class of Amino Acid | Examples of Amino Acids |
| --- | --- |
| Nonpolar | Ala, Val, Leu, Ile, Pro, Met, Phe, Trp |
| Uncharged Polar | Gly, Ser, Thr, Cys, Tyr, Asn, Gln |
| Acidic | Asp, Glu |
| Basic | Lys, Arg, His |

In some instances, non-conservative substitutions can also be made. The critical factor is that these substitutions must not significantly detract from the biological activity of the polypeptide.

An "isolated" or "substantially pure" nucleic acid molecule or polynucleotide is a polynucleotide that is substantially separated from other polynucleotide sequences which naturally accompany a nucleic acid molecule. The term embraces a polynucleotide sequence which was removed from its naturally occurring environment by the hand of man. This includes recombinant or cloned DNA isolates, chemically synthesized analogues and analogues biologically synthesized by heterologous systems. An "isolated" or "purified" protein or polypeptide, likewise, is a one removed from its naturally occurring environment.

Materials and Methods

Cells and Virus

AmEPV (Hall, R. L. and R. W. Moyer [1991] supra) was replicated in IPLB-LD-652 cells (Goodwin, R. H., J. R. Adams and M. Shapiro [1990] "Replication of the entomopoxvirus from *Amsacta moorei* in serum-free cultures of a gypsy moth cell line" *J. Invertebr. Pathol.* 56:190–205) which were maintained at 28° C. in a 1:1 mixed medium (TE medium) of TC-100 media (Gibco, Gaithersburg, Md.) and EX-CELL 401 media (JRH Biosciences, Lenexa, Kans.), supplemented with 10% fetal bovine serum. A TK negative cell line designated C11.3 was selected by a process of adaption of TK(+) LD652 cell to increasing levels, 10 µg/ml every 5 weeks, of 5-bromo-2'-deoxyuridine (BudR) over one year up to 100 µg/ml BudR and maintained in TE medium containing BudR (100 µg/ml). 293 cells were grown in DMEM medium supplemented with 5% fatal bovine serum.

Figure 1:
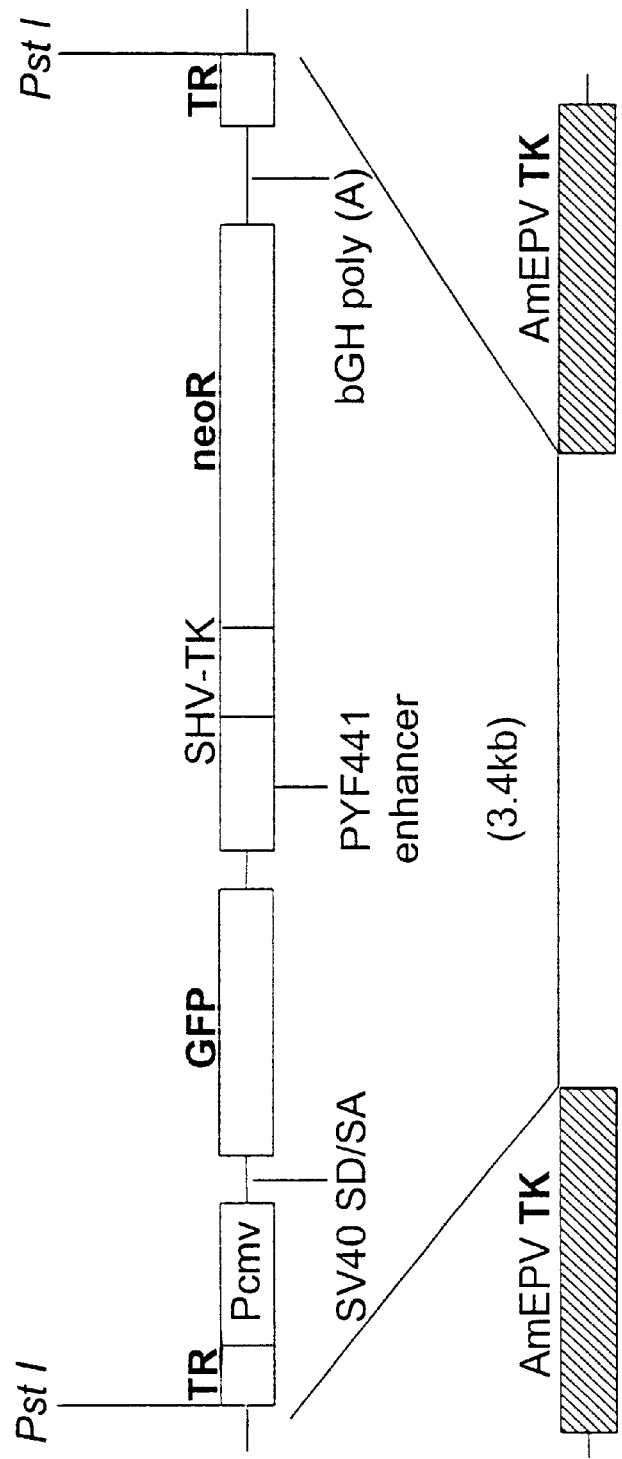
FIG. 1 shows a physical map of an exemplified recombinant vector of the subject invention (pAmEPV TKUF5) in which a portion of the plasmid pTKUF5 has been cloned within the AmEPV TK gene flanking regions. TR is the AAV terminal repeat; pA is a polyadenylationsite; SD/SA is the SV40 late splice donor, splice acceptor sequence. GFP, the green fluorescent protein gene, is under the control of a CMV promoter. Neo, the neomycin resistance gene, is under the control of a herpes TK gene promoter.

Plasmid Construction and Preparation of AmEPV Recombinant pTR-UF5 (see FIG. 1, provided by the Vector Core, Gene Therapy Center, University of Florida) contains GFP and NeoR genes under control CMV promoter and herpes virus TK promoter respectively and flanked by ITR sequences of AAV. The Pst I fragment which contains GFP and NeoR markers was inserted into Pst I site of pTKDU (Li, Y., R. L. Hall, S. L. Yuan, R. W. Moyer [1998] "High level expression of *Amsacta moorei* entomopoxvirus *Spheroidin* depends on sequences within the gene" *J. Gen. Virol.* 79:613–622) to produce pTKUF5. AmEPV recombinant with an insert in the TK gene was obtained as described previously (Li et al. [1998] supru).

Viral Genomic DNA Preparation

Growth and maintenance protocols for IPLB-LD-652 cells and AmEPV are described in detail in Bawden et al., 2000. DNA was obtained from amplification of a single wtAmEPV plaque (Bawden, A. L., Li, Y., Maggard, K., and Moyer, R. W. [2000] Entomopoxvirus Vectors. In "Viral Vectors: Basic Science and Gene Therapy," A. Cid-Arregui, Ed., Eaton Publishing, Natick, Mass. (In Press)). Thirty 150 $cm^2$ dishes containing approximately $2.4\times10^7$ LD652 cells (Goodwin, R. H., Adams, J. R., and Shapiro, M. [1990] "Replication of the Entomopoxvirus from *Amsacta moorei* in Serum-Free Cultures of a Gypsy Moth Cell Line" *J. Invertebr. Path* 56:190–205) were infected at an MOI of 0.01 with wild type AmEPV and incubated at 28° C. Infections (cells and medium) were harvested 6 days post-infection and centrifuged at 500×g for 15 minutes to remove cells. The supernatant was centrifuged at 40,000×g for 30 minutes to pellet virus. The pellet was resuspended in $dH_2O$ (100 μL for each initial 30 mL of supernatant). DNase free RNase was added to a final concentration of 50 μg/mL and incubated at 37° C. for 30 min. The sample and lysis buffer (100 mM Tris pH 8.0, 10 mM EDTA, 54% sucrose, 2% SDS, 10 mM β-mercaptoethanol) were brought to 50° C., and lysis buffer was added to the sample at a 1:1 ratio. Proteinase K was added to a final concentration of 0.6 mg/mL. The viral lysate was incubated overnight at 50° C. The lysate was extracted three times with 50:49:1 phenol:chloroform:isoamylalcohol, once with chloroform, and the DNA precipitated in 0.4 M $LiCl_2$, 95% ethanol.

Tsp509I Partial Digest Library Preparation

Ten micrograms of AmEPV DNA were digested with 5 units of Tsp509I. Two aliquots were removed at 3 and 6 minute time points and digestion stopped with 50 mM EDTA (final concentration). This method was repeated in triplicate for a total of 30 μg of digested DNA. Fragments of 2–3 kb and 4–5 kb were gel-purified separately with the Gene-Clean II kit (Bio 101 Vista, Calif.) and ligated into the EcoRI site of the PUC19 plasmid vector (Amersham Pharmacia Biotech UK Ltd., Chalfont, Buckinghamshire, England). The ligation mixture was transformed into DH5-α competent cells and plated onto LB agar plates containing 50 μg/mL ampicillin and 800 μg/plate each IPTG and X-gal (Horton, P. and Nakai, K. [1997] "Better prediction of protein cellular localization sites with the k nearest neighbors classifier" *Ismb.* 5:147–152). White colonies were isolated and grown overnight in 1 mL TB medium (Horton & Nakai [1997] supra) plus 50 μg/mL ampicillin.

Sequence Determination

Plasmid DNA was prepared using the QIAgen BioRobot 9600 and the QIAprep 96 Turbo miniprep kit. Sequencing was performed with 200–500 ng of plasmid DNA as template using a 0.25× concentration of ABI Prism BigDye Terminator Cycle Sequencing Ready Reaction kit (#4303153; Perkin-Elmer Applied Biosystems [ABI], Foster City, Calif.). Cycle sequencing was performed using a PTC-200 DNA Engine (MJ Research, Watertown, Mass.) (25 cycles: 1 degree per second to 96 degrees; 96 for 10 seconds; 1 degree per second to 60 degrees; 60 for 4 minutes). Dye terminator removal was on Multiscreen-HV plates (Millipore) with Sephadex G-50 superfine (Sigma, St. Louis, Mo.) in water. The reactions were electrophoresed on an ABI 377 sequencer, and the chromatograms were edited with Analysis version 1.2.1 (ABI) and assembled as follows.

Sequence Assembly and Analysis

Chromatograms were assembled into "contigs" using the Phred/Phrap/Consed software package (Horton, P, and Nakai, K. [1996] "A probabilistic classification system for predicting the cellular localization sites of proteins" *Ismb.* 4:109–115; Altschul, S. F., Madden, T. L., Schaffer, A. A., Zhang, J., Zhang, Z., Miller, W., and Lipman, D. J. [1997] "Gapped BLAST and PSI-BLAST: a new generation of protein database search programs" *Nucleic Acids Res.* 25:3389–3402; Bateman, A., Birney, E., Durbin, R., Eddy, S. R., Finn, R. D., and Sonnhammer, E. L. [1999] "Pfam 3.1: 1313 multiple alignments and profile HMMs match the majority of proteins" *Nucleic Acids Res.* 27:260–262). After assembling 3500 chromatograms into 6 contigs. Consed designed 43 finishing experiments. Custom oligonucleotide primers were synthesized by Integrated DNA Technologies (Coralville, Iowa), and upon completion of the experiments, the assembly contained the entire unique region of the genome and one inverted terminal repeat (ITR). After further data manipulation using the programs phrapview and miropeats, the ITR regions on either end were delineated (Horton & Nakai [1996] supra; Altschul, S. F., Gish, W., Miller, W., Myers, E, W., and Lipman, D. J. [1990] "Basic local alignment search tool" *J. Mol. Biol.* 215:403–410). The consensus was sequenced to an average redundancy of 10 ×. The sequence was confirmed by comparision to BamHI, EcoRI, HindIII, PstI, and XhoI, restriction maps of AmEPV (Hall, R. L, and Hink, W. F. [1990] "Physical mapping and field inversion gel electrophoresis of *Amsacta moorei* entomopoxvirus DNA" *Arch. Virol.* 110:77–90). The sequence of AmEPV has been deposited into GenBank, nucleotide acession number AF250284. Methionine-initiated open reading frames were delineated using Vector NTI. Open reading frames that translated into proteins less than 60 amino acids were discarded from our analysis. Relevant homologies were determined by BLAST analysis (Parsons, J. D. [1995] "Miropeats: graphical DNA sequence comparisons" *Comput. Appl. Biosci.* 11:615–619; Ewing, B., Hillier, L., Wendl, M. C, and Green, P. [1998] "Base-calling of automated sequencer traces using phred. I. Accuracy assessment" *Genome Res.* 8:175–185), and additional domains found using the Pfam program (Gordon, D., Abajian, C., and Green, P. [1998] "Consed: a graphical tool for sequence finishing" *Genome Res.* 8:195–202). Default E (EXPECT) values of <0.01 were used to define homology to sequences in current databases. Transmembrane (TM), leucine zipper, and signal peptide (SP) domains were predicted by the Psort program (van Veen and Konings [1998] supra; Ewing, B. and Green, P. [1998] "Base-calling of automated sequencer traces using phred. II. Error probabilities" *Genome Res.* 8:186–194).

Following are examples which illustrate procedures for practicing the invention. These examples should not be construed as limiting. All percentages are by weight and all solvent mixture proportions are by volume unless otherwise noted.

EXAMPLE 1
Gene Expression in Cells Infected with Recombinant AmEPV 293 cells ($1\times10^6$) were placed in 6-well plate and infected with recombinant AmEPVpTKUF5 or AmEPVpTKespgfp (Li et al. [1997] supra) viruses at a multiplicity of five (5) virus particles/cell. As controls, cells were separately transfected with either the plasmid pTR-UF5 or pTKUF5 at a 5 µg/well plasmid DNA. Two days later, virus infected or plasmid transfected cells were transferred into 60 mm dishes, after 24 hr, neomycin resistant colonies were selected by adding G418 at the final concentration of 200 µg/ml. G418 containing medium was changed every 3-4 days.

For cells infected with recombinant AmEPV pTKespgfp, no neomycin resistant colony was observed, an expected result since this virus does not have NeoR gene. However, in cells infected with recombinant AmEPV pTKUF5 or transfected with plasmids pTR-UF5, G418 resistant colonies were observed. All colonies from cells transfected with either of the two plasmids were both G418 resistant and GFP positive. However, colonies from cells infected with recombinant pTKUF5 were initially only G418 resistant, and not GFP positive. G418 resistant colonies derived from the AmEPV recombinant also grew more slowly than those produced following plasmid transfection. Most likely, the explanation for these results is that GFP and NeoR gene copy number in AmEPV derived colonies is less than those transfected with plasmids. This explanation is likely to be true as we were able to show that the AmEPV derived colonies gradually become more and more resistant to G418 and soon, some GFP positive clusters of cells were observed which become more numerous and brighter. After several changes of medium, ultimately, all cells in the well were GFP positive.

Figures 2A, 2B:
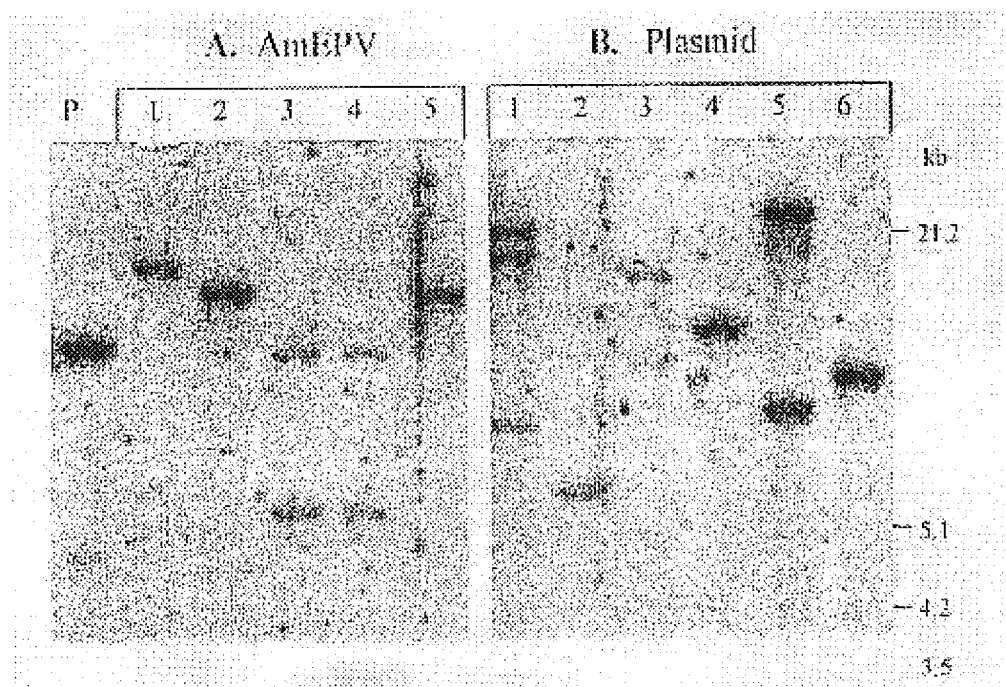
FIGS. 2(A+B) shows an electrophoretic analysis of transformed mammalian cell lines. Each lane contains HindIII digested genomic DNA. Lane P contains genomic DNA from 293 cells and pTR-UF5 plasmid, as a positive control. Lanes A1 through A5 contain DNA extracted from transformed cell lines made by recombinant AmEPV (AmEPVpTKUF5) infection. Lanes B1 through B6 contain DNA obtained from cell lines transfected with plasmid pTR-UF5.

EXAMPLE 2
Stable Integration of Foreign DNA Sequences into Mammalian Cells Infected with Recombinant AmEPV Genomic DNA was recovered from cell lines created by either infection with the virus AmEPVpTKUF5 or following transfection with a control plasmid pTR-UF5. Specifically, the recombinant AmEPVpTKUF5 was used to infect and subsequently select 293 (human kidney) cells at a multiplicity of 5 plaque forming units per cell, as described in Example 1. After growing the isolated cell lines reliably for multiple generations, DNA was isolated and digested with HindIII before electrophoresis and blotted with a random labeled probe containing the gfp and neo genes which are contained within the ITR regions of pTR-UF5. As shown in FIG. 2, lane P contains genomic DNA from 293 cells and pTR-UF5 plasmid, showing excision of the cassette from the plasmid upon digestion. A control (not shown) of 293 cells alone did not produce any endogenous cross-reacting bands. As seen in FIG. 2, the host chromosomal site in the 293 genome of integration is random, as evidenced by the different sized bands resulting from HindIII digestion. In some cell lines, the event can be seen to have occurred more than once (multiple copies have integrated). Directional integration into the long arm of chromosome 19 would be expected if the rep gene of AAV were simultaneously expressed. This experimental data proves delivery and stable integration of foreign DNA sequences by AmEPV.

EXAMPLE 3
Growth and Amplification of AmEPV

AmEPV productively infects *Lymantria dispar*-derived IPLB-LD-652 (LD) cells (Goodwin et al., 1978). LD cells were maintained at 28° C. in a 1:1 ratio of TC-100 medium (Gibco, Gaithersburg, Md.) to EX-CELL 401 medium (JRH Biosciences, Lenexa, KN) supplemented with 10% fetal bovine serum, 50 U/ml penicillin, and 50 µg/ml streptomycin (1:1 TE). To amplify virus, cells grown in 150 mm dishes are inoculated at a multiplicity of infection (m.o.i.) of 0.01 in sufficient media (5 ml) to cover the surface of the tissue culture vessel. The cells should be no more than 70% confluent. After adsorption at 28° C. for 2 hr, 25 ml medium is added and the infections are incubated for 4–6 days at 28° C. The infection is considered complete when most cells become occlusion body positive as seen by light microscopy, i.e. when refractile occlusion bodies can be seen. For recombinant viruses in which lacZ has been inserted into either the TK or the spheroidin locus, infection is monitored by in situ staining of infected cells with 1 mg/ml 5-Bromo-4-chloro-3-indolyl-β-D-galactopyranoside (Xgal), 4 mM potassium ferricyanide, 4 mM potassium ferrocyanide, and 2 mM $MgCl_2$ in phosphate buffered saline (PBS) (140 mM NaCl, 2.7 mM KCl, 10 mM $Na_2PO_4$, 1.8 mM $KH_2PO_4$, pH 7.4). This stain allows β-galactosidase producing infected cells to be visualized by the appearance of blue color. Though numbers can vary, an AmEPV infection at an m.o.i. of 0.01 generates a net yield of approximately 1.5 plaque forming units (PFU) based on the total number of cells and results in a 100-fold increase in PFU. Titers are routinely between $10^5$ and $10^6$ PFU/ml. Cells infected at a higher m.o.i. can generate higher yields/cell (~10) but the net increase in virus over input is lower.

EXAMPLE 4
Partial Purification and Concentration of Virus

Some experiments necessitate higher concentrations of virus. The procedure that follows typically renders semi-pure virus stocks at titers>$10^8$ PFU/ml. AmEPV infected cells are harvested by scraping and centrifuged at 700×g for 15 min to remove cells. The supernatant is then subjected to ultracentrifugation at 70,000×g for 2 hr to pellet the extracellular virus. The virus is resuspended in an appropriate amount of PBS (typically 100 µl per 40 ml of supernatant) and the titer is determined by plaque assay. Total yield is typically 50% of input virus.

EXAMPLE 5
Plaque Assay

Virus to be titered is subjected to 10-fold serial dilutions in 1:1 TE medium. LD-652 cells are plated at 70% confluency in 6-well dishes, each having a 34.6 mm diameter (roughly $1.4\times10^6$ cells per well). Once the cells have adhered, the medium is removed and 0.5 ml of diluted virus is added to the wells. After adsorption at 28° C. for 2 hr, the inoculum is removed and 2.5 ml of overlay is added to each well. The overlay is a 2:1 ratio of 1.33×TC-100 medium (containing 14% fetal calf serum) and 4% sterile low melting point agarose, equilibrated to 42° C. and mixed just prior to addition to the monolayer.

Figures 3A, 3B, 3C:
FIG. 3(A-F) shows expression of lacZ in recombinant AmEPV-infected mammalian cells. CV-1 cells were mock infected (A) or infected with various AmEPV lacZ recombinants, where lacZ was under the control of the cowpox virus late ATI gene promoter (B), the late AmEPV spheroidin promoter (C), the M. melonontha early fus promoter (D) or the AmEPV early esp promoter (E). Infection of human Huh-7 liver cells with the AmEPV TKesp-lacZ recombinant is also shown as an additional control (F). The infected cell monolayers were stained with X-gal 24 h postinfection.
Figures 3D, 3E, 3F:
Figure 4A:
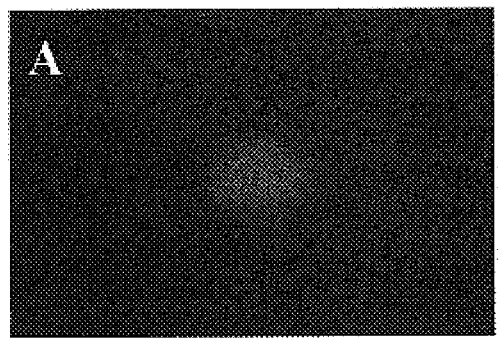
FIG. 4(A-D) shows the survival of mammalian cells following infection by recombinant AmEPV TKesp-gfp. Subconfluent CV-1 cells were infected with AmEPV TKesp-gfp at an m.o.i. of 1 PFU/cell. The individual fluorescent cells were located and followed over a period of two to three days and periodically photographed with a fluorescent microscope. One fluorescent cell, identified 18 hours post infection (A), had divided into two cells by 24 (B) to 26 (C) h postinfection and by 50 h had become a small cluster of dividing cells (D).
Figure 4B:
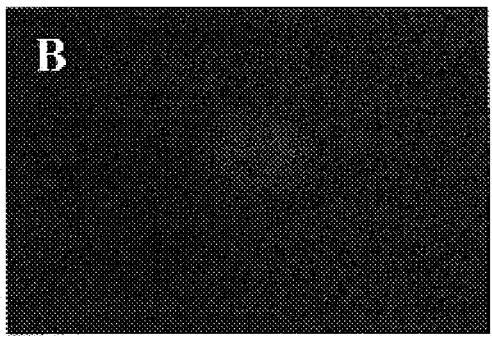
Figure 4C:
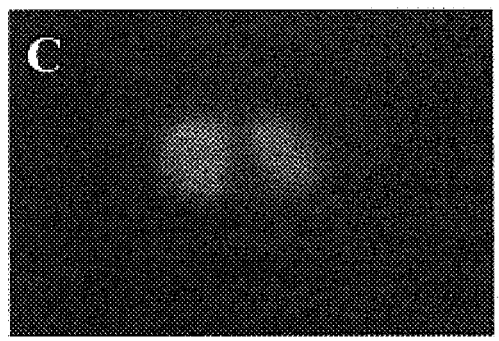
Figure 4D:
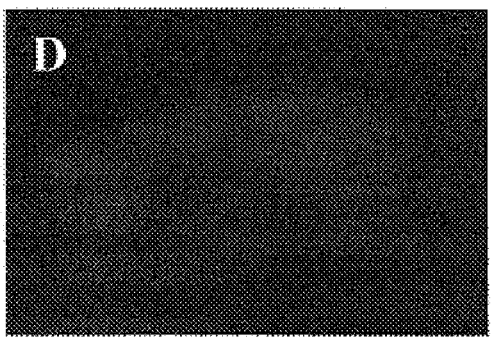

For a spheroidin-positive virus, visible plaques appear and are counted one week post infection (FIG. 3). Spheroidin-negative virus plaques are much more difficult to visualize, hence most spheroidin negative viruses have been engineered to contain lacZ. Such viruses can be readily visualized by staining with Xgal as follows: a liquid overlay of 400 µg Xgal in 50 µl total solution is spread over the agarose in each well of the plaque assay 3–4 days post-infection. Plaques appear as blue patches of infected cells and are counted one week post-infection.

Comet-like plaques of wtAmEPV, in the absence of an agarose overlay can be more rapidly visualized by immunostaining (Winter, J., R. L. Hall, and R. W. Moyer [1995]

"The effect of inhibitors on the growth of the entomopoxvirus from *Amsacta moorei* in *Lymantria dispar* (gypsy moth) cells" *Virology* 211:462–473). Plaque assays are prepared as above, except that a liquid overlay of medium replaces the agarose overlay. Infected cell monolayers are air dried three days postinfection and fixed in acid alcohol (95% EtOH, 5% glacial acetic acid) for 30 minutes. After equilibration with TBS (0.02 M Tris pH 7.4,0.15 M NaCl) the cells are incubated in TBS-Block (0.5% w/v blocking reagent in TBS [Boehringer Mannheim, Germany]) for 1 hr at room temperature to prevent nonspecific antibody binding. The primary antibody (rabbit anti-AmEPV occlusion body antiserum) (Hall et al. [1996] supra) or secondary antibody (goat anti-rabbit conjugated to alkaline phosphatase; Fisher, Atlanta, Ga.) are both diluted in TBS-Block. Antibody reactions and color development are performed as previously described (Harlow, E., and D. Lane [1998] *Antibodies*—A Laboratory Manual, E. Harlow and D. Lane, Eds., pp. 635–657. Cold Spring Harbor Laboratory, Cold Spring Harbor, N.Y.).

EXAMPLE 6
Isolation of AmEPV Genomic DNA

LD-652 cells (typically $10^9$ cells, thirty 150 mm dishes) are infected with AmEPV at an m.o.i. of 0.01. The infections (cells and medium) are harvested by scraping and centrifuged at 700×g for 15 min. to remove cells. The supernatant is centrifuged at 39,000×g for 30 min. to pellet extracellular virus. The viral pellet is resuspended in deionized water (100 $\mu$l for 40 ml of supernatant). DNAase free RNAase is added to the resuspended viral pellet at a final concentration of 50 $\mu$g/ml and incubated at 37° C. for 30 min. The virus sample is then heated to 50° C., and an equal volume of lysis buffer (100 mM Tris pH 8.0, 10 mM EDTA, 54% sucrose, 2% SDS, 10 mM β-mercaptoethanol) is added to the sample. Proteinase K is then added to a final concentration of 0.6 mg/ml, and the viral lysate is incubated overnight at 50° C. The lysate is extracted three times with 50:49:1 phenol:chloroform:isoamylalcohol and once with chloroform, and the DNA is precipitated in 0.4 M LiCl, 95% ethanol. This procedure typically yields 2 $\mu$g of genomic AmEPV DNA per $10^7$ infected cells.

EXAMPLE 7
Shuttle Vector Plasmid Construction

Following the sequence determination of two nonessential genes, thymidine kinase (TK) and spheroidin (Gruidl et al. [1992] supra; Hall and Moyer [1991] supra), we were able to create shuttle vector plasmids for the generation of recombinant AmEPV viruses. The shuttle vectors are described below.

A. The TK Insertion Site Shuttle Vector

Oligonucleotideprimers were used to PCR amplify a 748-bp fragment of downstream TK flanking sequence from plasmid pMEGTK-1 (Gruidl et al. [1992] supra). Another set of oligonucleotide primers was used to PCR amplify a 663-bp fragment of TK upstream flanking sequence from pMEGTK-1. These two fragments were separately inserted into pBluescriptI SK(+) to produce pDUTK (Li, Y., Hall, R. L., and Moyer, R. W. [1997] "Transient, nonlethal expression of genes in vertebrate cells by recombinant entomopoxviruses" *J. Virol.* 71:9557–9562). Foreign genes were then cloned within the TK flanks to generate shuttle vectors for the generation of recombinants (Li, Y., Hall, R. L., and Moyer, R. W. [1997] "Transient, nonlethal expression of genes in vertebrate cells by recombinant entomopoxviruses" *J. Virol.* 71:9557–9562).

B. The Spheroidin Insertion Site Shuttle Vector

Oligonucleotides were used to PCR amplify a 1046-bp fragment of upstream spheroidin flanking sequence from plasmid pRH512 (Hall and Moyer [1991] supra). In addition to 1023-bp of sequence upstream of the spheroidin gene, this fragment contained the starting ATG of the spheroidin coding sequence and twenty base pairs following the ATG. Another set of oligonucleotide primers was used to amplify a 998-bp fragment of downstream spheroidin flanking sequence from pRH512. These two fragments were separately inserted into pBluescript I SK(+) to produce pDU20 (Hall, R. L., Li, Y., Feller, J. A., and Moyer, R. W. [1996] "The *Amsacta moorei* entomopoxvirus spheroidin gene is improperly transcribed in vertebrate poxviruses" *Virology* 224:427–436). Subsequent constructs were cloned within the spheroidin flanks to generate various shuttle vectors for the generation of recombinants (Hall et al. [1996] *Virology* 224:427–436).

C. AmEPV Early Promoter Constructs

Promoters for early poxvirus genes are active prior to viral DNA replication. We have utilized two early EPV promoters in our constructs. The first, an AmEPV early strong promoter (esp) was derived from a strongly expressed 42 kDa early protein (Li, Y., Hall, R. L., and Moyer, R. W. [1997] "Transient, nonlethal expression of genes in vertebrate cells by recombinant entomopoxviruses" *J. Virol.* 71:9557–9562). The second promoter was derived from the early expressed fusolin (fus) gene as described (Gauthier et al. [1995] supra). These promoters have been used to regulate reporter genes (lacZ, gfp). The appropriately regulated genes are then placed within shuttle vectors and transfected into infected cells to produce recombinant viruses. The shuttle vector pTK-fuslacZ was constructed by PCR amplification of the MmEPV fusolin early promoter from pHF51 and insertion into pDUTK; lacZ was subcloned from pMC1871 (Pharmacia Biotech, Inc., Piscataway, N.J.) as described (Li, Y., Hall, R. L., and Moyer, R. W. [1997] "Transient, nonlethal expression of genes in vertebrate cells by recombinant entomopoxviruses" *J. Virol.* 71:9557–9562). The shuttle vector pTK-esplacZ (pTK-42klacZ) was constructed by cloning the PCR amplified esp promoter into pTK-fuslacZ after excision of the fusolin promoter (Li, Y., Hall, R. L., and Moyer, R. W. [1997] "Transient, nonlethal expression of genes in vertebrate cells by recombinant entomopoxviruses" *J. Virol.* 71:9557–9562). To construct pTK-espgfp, a green fluorescent protein gene (gfp) was PCR-amplified from the pTR-UF5 plasmid (Vector Core, University of Florida) (18) and cloned into pTK-esplacZ replacing the esplacZ cassette as described in (Li, Y., Hall, R. L., and Moyer, R. W. [1997] "Transient, nonlethal expression of genes in vertebrate cells by recombinant entomopoxviruses" *J. Virol.* 71:9557–9562).

D. AmEPV Late Promoter Constructs

We have used the spheroidin (sph) promoter as an example of an AmEPV strong late promoter. This promoter has two rather unexpected properties: (1) the sph promoter appears to be insect cell specific and functions very poorly in vertebrate cells (Hall et al. [1996] supra), and (2) unlike previously described late poxvirus promoters, we have found in insect cells that expression is further enhanced by including the 20 bp downstream of the TAAATG promoter in the reporter gene constructs (23), pDU20lacZ was created by insertion of lacZ (from plasmid pMC1871, Pharmacia Biotech, Inc., Piscataway, N.J.) into the BamHI site of pDU20. The final reporter contains 1046 bp of potential spheroidin promoter sequence plus 20 bp of additional downstream spheroidin coding sequence following the TAAATG sequence before fusion to lacZ (Hall et al. [1996] supra). pDU2lacZ was constructed using the same strategy as that for pDU20lacZ, except that only 2 bp of spheroidin coding sequence follows the translation-starting TAAATG before fusion to lacZ (Hall et al. [1996] supra, Li, Y., R. L. Hall, S. Yuan, and R. W. Moyer [1998] "High-level expression of *Amsacta moorei* entomopoxvirus *sphieroidin* depends on sequences within the gene" *J. Gen. Virol.* 79:613–622). We have also constructed and used the cowpoxvirus late ATI gene promoter to drive lacZ which functions well in both insect and vertebrate cells (Li, Y., R. L. Hall, S. Yuan, and R. W. Moyer [1998] "High-level expression of *Amsacta moorei* entomopoxvirus *spheroidin* depends on sequences within the gene" *J. Gen. Virol.* 79:613–622).

E. Construct Driven by Pol II Specific Promoters

An AmEPV construct containing reporter genes driven by Pol II rather than poxvirus promoters has also been prepared based on the plasmid pTR-UF5 (Vector Core, University of Florida) (Klein, R. L., E. M. Meyer, A. L. Peel, S. Zolotukhin, C. Meyers, N. Muzyczika, and M. A. King [1998] "Neuron-specific transduction in the rat septohippocampal or nigrostriatal pathway by recombinant adeno-associated virus vectors" *Experimental Neurology* 150:183–194) which is a plasmid containing two mammalian reporter genes: (1) a gene coding for neomycin resistance (neoR) driven by the herpes simplex virus TK promoter and (2) gfp driven by the immediate early promoter/enhancer from cytomegalovirus(CMV). The dual gene cassette is flanked by the AAV-inverted terminal repeats (ITRs), pTR-UF5 was digested with SalI to remove two PstI sites then religated to form pTRUF5)SalI. This construct was then digested with PstI, and the fragment containing the two reporter genes was inserted into the PstI site of pDUTK to produce pTKUF5)SalI. This construct was then digested with SalI and the previously removed SalI fragment was reinserted into the construct to produce pTKUF5 (FIG. 1).

EXAMPLE 8

Generation and Selection of Recombinant AmEPV

Neither the spheroidin gene nor the thymidine kinase gene is required for propagation of AmEPV in cell culture (Palmer, C. P., D. P. Miller, S. A. Marlow, L. E. Wilson, A. M. Lawrie, and L. A. King [1995] "Genetic modification oft an entomopoxvirus: deletion of the spheroidin gene does not affect virus replication in vitro" *J. Gen. Virol.* 76:15–23; R. W. Moyer, Li, Y. and Bawden, A., unpublished results), providing sites for insertion of foreign genes by homologous recombination. Following transfection of AmEPV infected LD-652 cells, all foreign genes are inserted into either the TK or the spheroidin locus (Hall et al. [1996] supra).

A. Transfection of Infected Cells

LD-652 cells ($1.4\times10^6$ cells, 70% confluent in a 34.6 mm dish) are infected with AmEPV at an m.o.i. of 5 PFU per cell in a volume of 1 ml. Two hours post-infection, the inoculum is aspirated and 1 ml of transfection mix+DNA is added.

Transfection mix+DNA is prepared by separately combining 20 $\mu$l Lipofectin (Gibco, Gaithersburg, Md.) and 80 $\mu$l 1:1 TE media without FBS, and 5 $\mu$g of shuttle vector plasmid DNA in a volume of 100 $\mu$l of the same media. The mixture is incubated at room temperature for 15 min. The concentrated transfection mix is then diluted by addition of 800 $\mu$l of 1:1 TE without FBS and added to cells. After 6 hr, the transfection mix is removed and replaced with 2 ml of 1:1 TE with 10% FBS. Three days post-infection the supernatant is harvested by centrifugation at 200×g.

B. Selection of AmEPV Recombinants

For selection of recombinants inserted into the TK gene, a TK(−) cell line, C11.3, was derived by serial passage of LD-652 cells in increasing concentrations of 5-bromo-2'-deoxyuridine (BudR) (10 $\mu$g/ml increasing increments of BudR at intervals of five weeks over one year). C11.3 cells are maintained at in 1:1 TE medium supplemented with 100 $\mu$g/ml BudR (Li, Y., Hall, R. L., and Moyer, R. W. [1997] "Transient, nonlethal expression of genes in vertebrate cells by recombinant entomopoxviruses" *J. Virol.* 71:9557–9562). Supernatants harvested from the infection/transfection described above are plaqued on C11.3 cells in the presence of 100 $\mu$g/ml BudR. Only virus lacking a functional TK gene, i.e. recombinant virus, will grow in the presence of BudR. For selection of recombinants where insertion is within the spheroidin gene (where lacZ has been incorporated into the shuttle plasmid) recombinant virus plaques are identified following staining with Xgal as described above or by the selection of non-refractile plaques.

C. Purification of Recombinants

Dilutions at $10^{-2}$ to $10^{-4}$ of the infected cell supernatant are assayed by repeated plaquing (described above). Individual plaques are isolated and diluted in 1 ml 1:1 TE medium plus 10% FBS. Isolates are replaqued at dilutions at $10^{-1}$ to $10^{-3}$. The plaque purification is repeated 3–4 times prior to plaque expansion for the propagation of larger stocks. These viruses can be stored at 4 oC for 2–3 months or at −80° C. for long-term storage.

EXAMPLE 9

Foreign Gene Expression in Permissive Insect Cells

In our hands, we find the level of foreign gene expression within infected insect cells when driven by either of two late promoters (the cowpox virus ATI or spheroidin +20 promoters) equals or exceeds that of vaccinia or baculoviruses on a per/cell basis. The technology needs no elaboration, as once suitable recombinant viruses are constructed, only appropriate infection of insect cells is necessary.

EXAMPLE 10

Transient Expression in Vertebrate Cells

The normal host range of AmEPV is limited to Lepidoptera (butterflies), and early experiments attempting to infect vertebrate cells with AmFPV indicated no obvious deleterious effects on the cells. Given the general promiscuity of poxviruses in the binding and entering of cells and the similarity of the AmEPV life cycle to that of vaccinia, we had reason to believe AniEPV would infect and enter vertebrate as well as insect cells. AmEPV recombinants were constructed carrying the lacZ reporter gene regulated by either of two early AmEPV promoters, the late spheroidin promoter or the ATI promoter from cowpox (TK-fuslacZ, TK-esplacZ, SPH(20)lacZ and TK-ATIlacZ, described above). When mammalian CV-1 cells were infected with the recombinant viruses at an m.o.i. of 10 PFU/cell, those cells infected with AmEPV recombinants where lacZ was regulated by either the MmEPV fusolin or the AmEPV 42 kD protein early promoters, expressed β-galactosidase (FIG. 3, panels D and E) (Li, Y., Hall, R. L., and Moyer, R. W. [1997] "Transient, nonlethal expression of genes in vertebrate cells by recombinant entomopoxviruses" *J. Virol.* 71:9557–9562). No expression was observed for the recombinants where lacZ was under control of either of the two late promoters (FIG. 3, panels B and C). Thus. AmEPV enters vertebrate cells and undergoes at least a partial uncoating which allows early, pre-replicative viral genes to be expressed. The infection is blocked thereafter and neither viral DNA replication nor late protein synthesis is observed. Early expression results from the fact that AmEPV, like other poxviruses, packages the enzymes necessary for early gene transcription within the virion. However, if vertebrate cells are co-infected with both VV and AmEPV, late promoters within AmEPV are rescued and activated suggesting that vaccinia can provide factors in trains which are needed for the infection to progress and activate the late promoters.

While determining the basis of host range restriction is difficult, the cytoplasmic nature of AmEPV coupled with a virus encoded transcription and replication machinery offers major advantages for vector design. We can be fairly certain that late genes are not transcribed because of the lack of β-galactosidase expression from late promoters in vertebrate cells and because DNA synthesis, a requirement for late mRNA synthesis does not occur. It is quite possible that incomplete uncoating of the virus leads to the block in gene expression.

Normally, uncoating of poxviruses occurs in two discrete steps. Upon entry into cells, virions are sufficiently permeabilized to allow early gene transcription from the viral core. Early proteins allow the complete uncoating of the core to allow transcription of the later classes of genes following interaction of newly synthesized DNA with intermediate and late transcription factors. The uncoating of vertebrate poxviruses has been thoroughly studied, and uncoating intermediates have been identified through differential centrifugation of cellular extracts infected with labeled virus. A viral activity specifically required for the second stage of uncoating has been identified. By analogy with vaccinia, AmEPV might be expected to encode a similar uncoating factor. If so, then one would not necessarily expect a cell-line specific block in uncoating unless this uncoating protein acts in conjunction with cellular components. Should we find that the particle is uncoated, then AmEPV fails to express other genes in vertebrate cells required for the infection to continue. Host range restriction of another insect virus family, the *Baculoviridae*, has received considerable attention. For baculoviruses blockage may occur at many stages during the activation of late or very late genes after viral DNA enters the nucleus (Carbonell, L. F., M. J. Klowden, and L. K. Miller [1985] "Baculovirus-mediated expression of bacterial genes in dipteran and mammalian cells" *J. Virol.* 56:153–160; Carbonell, L. F. and L. K. Miller [1987] "Baculovirus interaction with nontarget organisms: a virus-borne reporter gene is not expressed in two mammalian cell lines" *Appl. Environ. Microbiol.* 53:1412–1417; Morris, T. D. and L. K. Miller [1992] "Promoter influence on baculovirus-mediated gene expression in permissive and nonpermissive insect cell lines" *J. Virol.* 66:7397–7405; Morris, T. D. and L. K. Miller [1993] "Characterization of productive and non-productive AcMNPV infection in selected insect cell lines" *Virology* 197:339–348). The questions related to host range specificity are outside the scope of this review, but the limit of expression to those genes under the control of early promoters following infection of vertebrate cells is a key property of the virus which ultimately makes it a potential candidate as a vector for transient expression in vertebrate cells.

The most novel feature of this system is the survival and continued growth of the infected vertebrate cells. We immediately noticed that there were no observable cytopathic effects in the infected CV-1 cells. Survival and growth of the infected cells was shown following infection with recombinant AmEPV TK-espgfp. Initially, individual fluorescent cells resulted, which over a period of two to three days, divided to form fluorescent microclusters of cells (FIG. 4). There is no other known precedent of cells surviving a poxvirus infection. The fact that mammalian cells survive suggests that AmEPV offers the potential for a highly efficient, nontoxic method of foreign gene delivery into vertebrate cells for transient expression of foreign genes, after which the cells continue to grow unabated. While initial observations were made using CV-1 cells, these results have been extended to many other cell lines. In general, lymphocytic cells are more resistant to infection (Li, Y., Hall, R. L., and Moyer, R. W. [1997] "Transient, nonlethal expression of genes in vertebrate cells by recombinant entomopoxviruses" *J. Virol.* 71:9557–9562).

EXAMPLE 11

AmEPV Mediated Gene Expression in the Mouse

Figure 5:
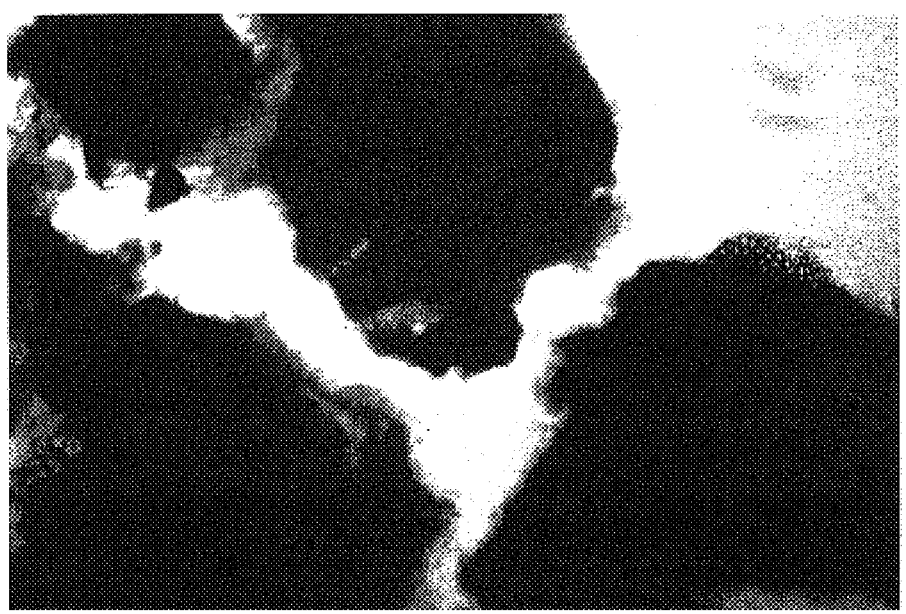
FIG. 5 shows AmEPV-mediated β-galactosidase expression in the muscle of mouse. 2×10⁶ PFU (100 μl) of recombinant AmEPV-esplacZ was injected into the muscle of the hind leg of a mouse. As a control, mice were injected with the same amount of recombinant AmEPV-SPHlacZ or 100 μl of PBS. Two days later, the mice were sacrificed, the muscle was excised from the injected area and cut into small pieces, and fixed with 3% formaldehyde for 30 min. then stained with X-gal. The muscle injected with recombinant AmEPV pTK-esplacZ showed β-galactosidase expression. No β-galactosidase expression was observed in control mice.
Figure 6A:
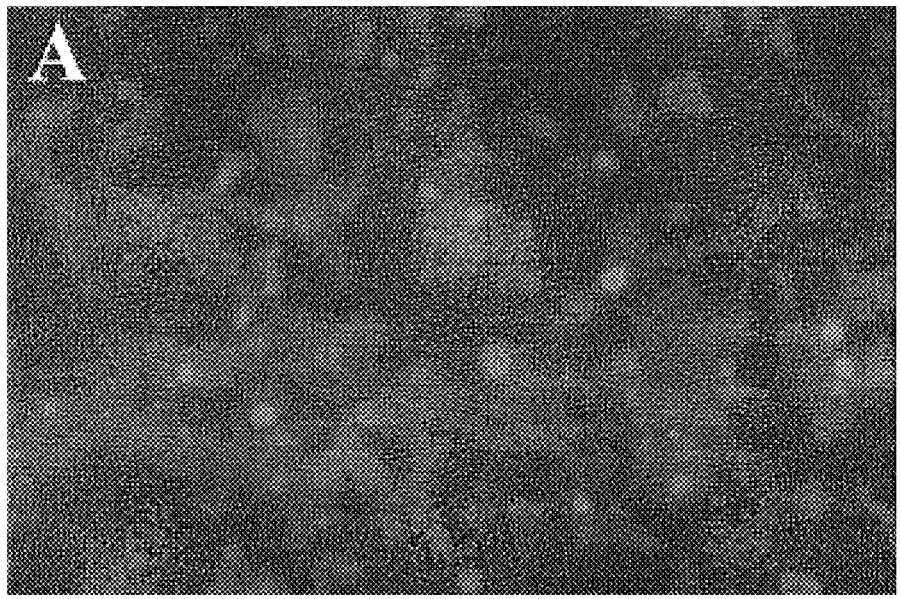
FIGS. 6(A+B) shows transformed 293 cells (A) derived from the colony infected with recombinant AmEPV-TKUF5 which are G418 resistant showing that cells are GFP positive, as well as non-fluorescent, non-transformed 293 cells (B).
Figure 6B:
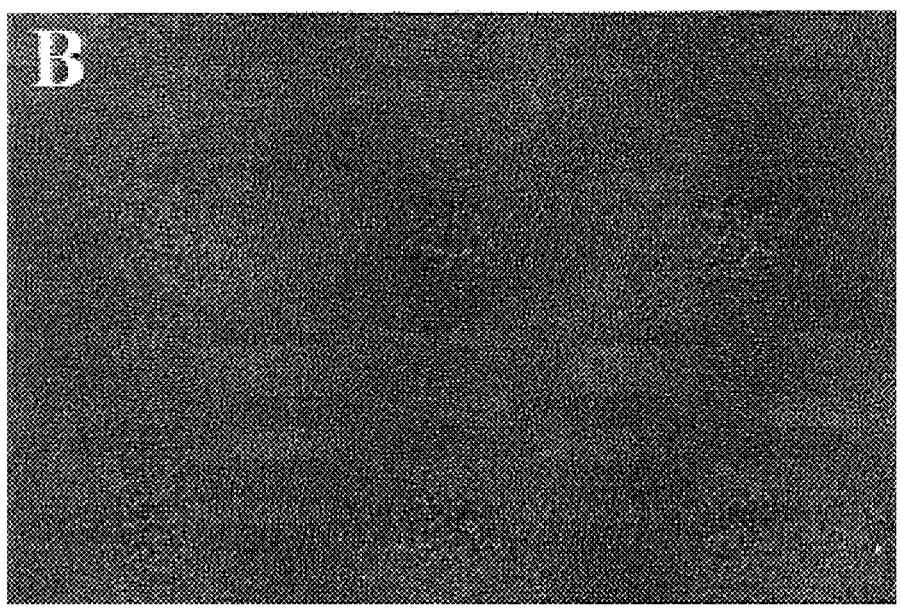

To examine the feasibility of AmEPV to deliver and express foreign genes in vivo, we examined the effects of injection of TK-esplacZ and SPH(20)lacZ into mouse muscle. Approximately 2×106 PFU (100 μl) of each virus was injected into the muscle of the hind leg of two separate mice; as an additional control, we also injected 100 μl PBS into a third mouse. Two days post infection, the mice were sacrificed and the muscle was excised into small pieces, fixed in a 3% formaldehyde solution for 30 min. and stained with X-gal. Extensive β-galactosidase expression occurred in the muscle from the TK-esplacZ infected mouse (FIG. 5). No expression was seen in either the SPH(20)lacZ or the PBS control. Thus, consistent with our observations of infected mammalian cells in culture, AmEPV can also enter cells in vivo and allow early, but not late expression of a reporter gene.

EXAMPLE 12

The Control of AmEPV Induced Inflammation

One concern with complex viral vectors is the potential for the unintended induction of inflammatory and immunological responses following administration. In studies with adenovirus, inflammation and immunogenicity to the virus and to virus-infected cells has limited transgene expression and the utility of this approach to treat chronic illnesses. Inflammation is initially characterized by perivascular and peribronchiolar inflammatory cell infiltration. Neutrophils and later macrophages and lymphocytes frequent the site of the infected area. Specific cytokines can also be measured as an index of the inflammatory response (Ginsberg, H. S., L. L. Moldawer, P. B. Sehgal, M. Redington, P. L. Kilian, R. M. Chanock, and G. A. Prince [1991] "A mouse model for investigating the molecular pathogenesis of adenovirus pneumonia" *Proc. Natl. Acad. Sci. U.S.A.* 88:1651–1655; Noah, T. L., I. A. Wortman, P. C. Hu, M. W. Leigh, and R. C. Boucher [1996] "Cytokine production by cultured human bronchial epithelial cells infected with a replication-deficient adenoviral gene transfervector or wild-type adenovirus type 5" *Am. J. Respir. Cell Mol. Biol.* 14:417–424).

The early response to adenovirus infection consists of diffuse cellular infiltration of peribronchiolar and alveolar regions associated with the appearance of several classes of pro-inflammatory cytokines (Ginsberg et al. [1991] supra; Noah et al. [1996] supra). These include TNF-a, IL-1, IL-6, and IL-8 (KC/GRO in the mouse). There is considerable experimental evidence from rodents demonstrating that these classes of cytokines, and in particular TNF-a and IL-8 (or KC/GRO), play central roles in the recruitment and activation of inflammatory cell populations in the lung.

It is likely with a virus as complex as AmEPV that unintended inflammation will result when the virus is introduced in vivo. However, vertebrate poxviruses may serve as a source of genes to provide a solution to this problem. There have been a variety of vertebrate poxvirus-encoded secreted virokines and viroceptors described including IFN-'/β.IFN-(.TNF and IL-1, and chemokine receptors (Barry, M. and G. McFadden [1997] "Virus encoded cytokines and cytokine receptors" *Parasitology* 115:S89–100; Smith, G. L., J. A. Symons, A. Khanna, A. Vanderplasschen, and Alcami, A. [1997] "Vaccinia virus immune evasion" *Immunol. Rev.* 159:137–154:137–154; Turner, P. C. and R. W. Moyer [1998] "Control of apoptosis by poxviruses" *Seminars in Virology* 8:453–469). Should inflammation be observed, cloning any or all of these genes into AmEPV to control any AmEPV induced inflammation is quite plausible.

EXAMPLE 13

The Use of AmEPV to Stably Transform Mammalian Cells

A. Considerations in the Design of AmEPV Vectors for Stable Transformation

Poxviruses are cytoplasmic and therefore poxvirus promoters are recognized only by the poxvirus encoded RNA polymerase and not by RNA polymerase II of the host cell. Since we wished to demonstrate the ability of AmEPV to mediate stable transformation of mammalian cells, we constructed a recombinant AmEPV containing a cassette in which gfp and a gene conferring neomycin resistance were cloned under the control of promoters recognized by the cellular (not poxvirus) RNA polymerase (FIG. 6). The promoters chosen were the CMV immediate early and herpesvirus TK gene promoters respectively, and the cassette was flanked by the inverted terminal repeat (ITR) sequences of AAV.

Although the exact mechanism of AAV site specific integration is unknown, two required viral components have been identified. These are the inverted terminal repeat sequences of AAV DNA (ITRs) and the Rep 78/68 proteins. The ITRs comprise two 145-nucleotide elements located at either end of the AAV genome. ITR sequences enclosing marker genes have been shown to allow a lower level of random genome integration when compared to the levels of specific integration observed when genes encoding the Rep 78/68 proteins are also included in constructs.

B. Selection of Stable Recombinants

When vertebrate cells are transfected with plasmid pTK-UF5, and selected with G418 (250 mg/ml) 24 hours later, colonies of resistant, fluorescent vertebrate cells are observed after about ten days of selection. In contrast, colonies from cells infected with AmEPVpTK-UF5 at an m.o.i. of five were G418 resistant, but not initially GFP positive. Approximately 20 G418-resistant clones can be isolated following infection of one million cells (one 35 mm dish). The efficiency of transformation is only 5–10 fold less than that for optimized plasmid mediated transfections. These AmEPV-derived colonies were observed to initially grow more slowly in the presence of G-418 than those produced from a plasmid transfection. Most likely, the explanation for these results is that the GFP and NeoR gene copy number in AmEPV-derived colonies is less than that for clones derived from cells transfected with the pTKUF5 plasmid. This explanation is further supported by the observation that the AmEPV derived colonies gradually became more resistant to G418 and that GFP expression while delayed, is ultimately observed. Fluorescent cells became both more numerous and brighter, consistent with a gradual increase in GFP concentration with time. Ultimately all cells in each clonal isolate were GFP positive, as shown in FIG. 6.

We are currently characterizing these cell lines, which have been grown reliably for multiple generations. Our unpublished data suggests random integration of the marker cassette into the cellular genome. Inclusion of the AAV rep gene in future constructs is anticipated to provide directed insertion into chromosome 19 (Samulski, R. J., X. Zhu, X. Xiao, J. D. Brook, D. E. Housman, N. Epstein and L. A. Hunter [1991] "Targeted integration of adeno-associated virus (AAV) into human chromosome 19" *EMBO J.* 10:3941–3950).

It should be understood that the examples and embodiments described herein are for illustrative purposes only and that various modifications or changes in light thereof will be suggested to persons skilled in the art and are to be included within the spirit and purview of this application and the scope of the appended claims.

SEQUENCE LISTING (80 sequences)

SEQ ID NO: 1 - DNA, 861 bp, Amsacta moorei entomopoxvirus
atgacaatatttgaaatattaatatggataattgttttattagcttttatgtttataatatttttatatgtggttttatatattaaaagaagaatatacgaaatattaaatgaaaatattcccattgaaataaatatagataatgtaaattatccaagtgaattatatacagataaatttaatcctaatgttttaaaatatttaattaaaatattgttagattttaatacagaaattacaaataacattattatacattcaattgattatatgaaaatatattatataagttataataaaaaaaaaataataaaattaatattagatagatataataatttatggattgttataagaggaacattaacatataatgaatttgaacacgatcttagaatttcacaagttaaaatagataactgtgatatgaaatgtcataaaggattttgtgaaatatatagtaaaatacaaaagccattactaaatttattaatgactttatcaccaaataaaatatttgcattaggtcatagtttaggaggcggaatattatcaatagcagcttatgatatttttaatattttaaataaaaaagaaattatattatatacaacgggaacacctcgtgtatgtaataaagatttttataataattgcaataaatataatatacataaagtagaaaatttaagtgatgtatatataaatgcaataccttctgttttaccattttatgataatacagtatattataaaataggaaaaatatggtattttgatgttaattacggaaatataatattaaatcataaactagaaatttattttaacaatattgataatctaaaatatttagaaatt

SEQ ID NO: 2 - DNA, 456 bp, Amsacta moorei entomopoxvirus
atgaaagctatatgtgttatgaccggaaaagttaatggaataatatattttatacaaaatattaaaggaggatctgtacacgtaaaaggaaaaatagttggattatctaaaggattacacggatttcatgttcatgaatatggtgatgtgagtaatggttgtacatcagcaggagaacattttaatccatataatagacaacatggagatattagtgataaaatacatcgtcatgttggtgattttggtaatgtgtatgcagacgaaaatggcgttgctaatattgattttcacgatgatattatatcattgtgtggaacaaataatataataggaagaacattagtagttcatgattcgcctgatgatttaggaaaaactgatcaccctttgagtaaaacaagtggtaattctggcggaagattaggttgtggtattattggtattgcaaaagat

SEQ ID NO: 3 - DNA, 1359 bp, Amsacta moorei entomopoxvirus
atgtataataatgaatattttactaatcgtgttaaaattcataaaaaaatagatacaattaataaaaatgttttatatttagcatatagagatctcagagtttatgataattggtcatttttatattctcaaaatatagcatatttaaataattcttctatgtatgtattatatttaataaataaaaataataatataaatataagacaatataaatttttatatgaaggattgccagaattcgaatcacaatgcaaaaaatgtaatgtttcttttcatttattatcttataataataacataatatcaaattttataaataaatataaaataggacatgttataatagaacaaatgccgcttttattccacaaaaaatattatttagatccattaaaaaaattaaatgtcaatgtatatattgtagattctcataatattataccagtatgggtaacttcagataaacaggaatataacgcaagaacaataaggattaaaataaataaattaaaagatcaatatttaatcgaatttcctaaagttaaaattagtaatatacaacctatttttgtagaaaataattttgatataattcccaattatgataaaaaattaataaatatttatgaaatagtgggagggtatactaatggaattaatagaatgaataatttttttaaaaataaaataaacacatacaaagataaaaaaaataatccaaattatgaaaataccagtattttatcaccatggctacattgtggtatgatttcagctcaaagatgtgttttggaagcaaataaacttaaaaaaattaaagattataatatagaatcaatagattcgtttatagaggaaatttttataagaaaagaattatctgataatttttgttattataataataattataaatcttttgcatcttgtccaaattgggcaatattaactttagaaatacataaaactgataaaagaaataaaatatttagtttacgagaattagagtatggcaaaacagataataaactttggaattattgtcaatattatttattaaaatttggttatcttaatggatatatgagaatgttttgggcaaaaaaattaattgaatggactaattctcctcaagatgccatcgataaaacaatttatcttaatgataaatattttttcgatggatatgatcctatgggatatgttaatatattatggtcaataggaggattgcatgacagagcattcaaagaaagagaaatgtatggaaaaataagatttatgtcccaaccattaatgtataaaaaattaaatgtaaatgatttttataataatttcgataatgtaattaagtct

SEQ ID NO: 4 - DNA, 794 bp, Amsacta moorei entomopoxvirus
atgatggatgacattaacttgtataatgaatctgaaagattacaaacatttgaaaattgcccataaattttataactcctgaatcatttgctagtaatggattttattatataggtgagaatgatacagttaaatgtgtgtattgtggagtacaaataaataaatgggttgaaggcgataaaccagaaattgatcataaaaaattttctccaaattgtagttttttaaaatctaatgatggaatagatgagtgtggcaataataaaaatatatctaacattacacaaaaaggagcagttcatcctaatctatcaaatattgttgaaagacttaaaacatataaagagtggcctatttcaatgcctatttctacagaaaaactagcagaagctggattcttttatactggaaaaagtgataaagttaaatgcttttattgtgatggtggtttaaataaatgggaaacagacgatgatccttggatacaacacgcaagatggtttgataaatgtgattatgttaaacttgtaaaaggcaaagattttattcaaaaagtaatgacacaatccacgtttatcaaatcgtcgaaaaaagaaaatatacctgaaataaatatatcaaacgatgaaaaaaatgatataaaattatgtaaaatttgttatatcgaagaacgagttatttgttttgtgccttgtggtcatatattttgttgtggaaaatgtgctatatcgatggataaatgtccggtatgtcgaaataaaataaaaaacttaactcgcgtgtattatccttaa

SEQ ID NO: 5 - DNA, 885 bp, Amsacta moorei entomopoxvirus
atgaattttatgccacaatattactatataagtgatattaataatgaaattgaatatgacgaaaattttaatcctggtaaaaaatttgattttaaaagacaaggtcaaattaaattattaatgaatgaaataagatttttaacagaagatgtagaattacataaaaattacaaaaatgaaaatattaatattttatatattggttctggtaaaggatatcatatacctttattaattaatatgtattctgattataaaatacaatgggatctatacgatccatgtggtcattgtgaaaaattatataatatccaaaaaaataataataatataaaaatttatgatacatattttaataaatcggatgtagaaaaatatgaaaatatcgataatttactatttataactgacataaggactgtagataaccccgacgacgaaccaaatactaaaaatttaataaatgattatgaattacaaaattatatattaaaagaattaaaacctatatcattagtaaaacaacgcgatccttttcctaatgattgggatgattcttataaattatcaatacctgatggtaaggaatatatacaatgttttcaaaaatataattcagcagaatatagaatatttatatctggaattacaacttttgtagatatcaattctgttatattaaataaaagaggaattgatagaaaattagcttggtataatatgaaatatagatttcaaaatgataatgattataaaattgcatatagaatattaaataaatatataaaatcagaaaacaaaccaatattaaaaaaatataataatattaataaaaataatataaaaaatgtcattagatcattatctaaagaaatgggttattat

SEQ ID NO: 6 - DNA, 879 bp, Amsacta moorei entomopoxvirus
atggatgttaataaatatatatatgaatataataaaccactatattatacttattatgatttatgtagaaatatgaatgatgttatttatgattataataataatactattaaaaaatatatggatatattattatcacaaatacaatttttatccaacataaatattaaaaaaatatgcaataatactaatggtatagttaacatattatatattggatcttcaaaagcatatcattttaatatattaaatgaattatataaaaatttaactaatattcagtggtatttttatgatattatagatccgtgtattagcgtagagagattgtcttataatattatttttaataggaaactttttaccgaagatgatattatagattttaaagataaatatccactaatattaatatatgattatgatgataaatctaacgttagagatttattatatcattataatatgcaaaataatataataatatatttaaatccgacatattcgttgttaaaatttaaatatatgcctataaataaatggaataattcttttaatgattatgaatatatttcaactggtataaaatatttaccaacaataaaatcattacatactagaaatattatagataataaaaatataatgacattaacatttgatgagatagaatctgaaaattattacgaaaaaatgaattactataataattgttctggatataacgatatatataataatatttcaggttatatattaaataaatcaaatttatatgacaataataattcagcttataatatattaaaaatatatgaaaaaaatataataaatacaataaacgaagataaaatatttagatcaaaagaaaaatatatt

SEQ ID NO: 7 - DNA, 3318 bp, Amsacta moorei entomopoxvirus
atgccttttttaggaactggtatattaaaatttgatataacacagttacaaaataaagaaaaaggaagtgattataatgctattagatatctaaaaagaatattaaataaaccatgtgataatgatgatatattaataccgtatgataaactagaaagtaaagaaataaatattaaaatttataattggtatataataaaaccatcatcgttagaacaatttatagtatgtaaatgcaaagattatgataccgaagaaataatatatatattatttgatatatatgaatattttctttgtgattacgaattatcagaatcaaatacaaaattaaaaaatataaaaaataacatagataaatataaaaattcattcaatagttcttatttagttcttgaagattataaaataataacaaatgaagttaatatacaatattattataattatactgaagatagtaaaataacattaaataataatgatttagttttatttatgactccttataaaatagagaaaatatatagcaaatataatatattcattaatcaatataggtggttttatgtattaaataatatagaaccatctggatcatatagaataaatatggataatatgcaaaaaattaaaacatataataaaaataaaacatcatattattgcaaaaatcctaaattgttattttctaattatgttaaaatagataaacatattcctgcaagtcgcgtttctattgatatagaatgccaacattttggtgaatttccaacagctaataaatttcctatttctcacatttgtatagattggtatatggataagaatacaaatccgataaagaaaataataacattaataaactatgaaataataaaaaattatgtgggagaaaagaaagataaatttatatataccgaagttaataagttattaaatacaaataaagtatatattacaatatattgtacagaaaaatatatgctacattttgtattgtatactcttaggcaggatttcgattatgttttgacatacaacggacataattttgattttacatatattcaagataggaggaaaataaataagttaaaaggtttatgtttagataatgtatattctacaaatgagataaaaatatcaaaattttcttataatcaagatactacatatgaaattgacagcactaacggaattatatttttagatttatataattatattaaaaaaacatatccttcgtcaaatagttataagttatcagaaataactaaagaaagatttaatatattttgtaagatatcatataataataatgaatatattatcgaaccattgaatacaaaagctaataaaaacaaaatatctatattttatgatgttataagaactgctaattattgttttattaataataatccatataaaataaaaaataagacagaaattattgatgatatagaaaaattatatgatttaacatcgataaaaaattcgcataataaaaaatttaccatatatgaaaatgatattcctattaatgataattatgcaacagttatgttatctaaagatgatgttgatattggagataaaaatgcatatgttaattttactaaagaaaaatcagataatatagcctattattgtactcacgatactgtattatgtaattgtatttttaaatacgatatgatacatgataaaataatagcatttagcaatgaatatttattaccacagtgtatggcatttaaatacaaaagttccaataatatatcaggtttattattaaaaacattatattcaaataaaacaatgatatatccaggtaatgtagaatttgaaaaattcgaaggtggttatgttattgaaccaaaacaaaaatatattgatagtttaacagcagtgtttgattttaattccgaatatccatcaataatcatagaagcaaatttaagtccagaaaaagtagtaaaagtaataaagttatttgatgacgaagaagcggcaaataaagtagaaaaatatctaaaagataattataaatatcctgattattgttatattaaaattattaaagataaaatgtataaatttatactaatggatagaagagaattgggcgttactactcaaatggtaaaagatggcagagaaatgaaaaacatgtataaagatcttaaaaataaaaataaagataatgtagatttacataacttctattcttcagctttgtatagtaaaaaaataacgattaatagtatgtacggtttatctggttcagaaagatttatatttaattcgccatattgcgcagaatattgtacagtacaaggacaaaattgtattaaatatattcaaacattagtaaataattcaaaatatatagataatgttttaatacttaataaatgcaataatccttttacaaatgagcccataaaaactaattatcccggtaatttaaatgttaatttcacatttaatgtaaaatatggagacacagattctttatttataactgttaattttgaaagtaaatttaatagtaaagaagaaaaagttaaagtaggtcataaatgttttacatttttaggtaatgttataaatgataagaaaaataaaatattaacagataattttgaatttgaatatgagaagatgtattattggatgatattattagcaaaaaaaaaatatattggagaagttgtaattaacatggatcctttgcaattaatggatgatactaaaggtactgcgttaatacgtagagattgtactgtaatacataaaactattttaaaaaatactataaatatattaaaagattttttaacaaatgataataccggtataaatattaatgttaaaataaatgattatttatcatctgcatttaaaaatatcatagagaatatacaaaatttagatattaatgattttaaaaaatctgtaaaatatagtggtgtttataaagatcctaattatccaatagaattatgtgttaaagaatataatttaaaaaatcctaatgataaaataacaaaaggtcaaagatttgattttatatatgctcataaaataaatgaatggtcaaaagatataaaaaagtggaatataaaatatactatagatatttctaaacatgttataatattagaagactatctaaaaaataaaaataattatagaatatgtgttgaaaaatatataaaagatatattatcaaatttagatcaaattattaatgataaaaatataataaaaaatatagatattatgttaaatagttatgaaccacaatga

SEQ ID NO: 8 - DNA, 1836 bp, Amsacta moorei entomopoxvirus
atgaatgatatcgataaaaataatatattaaacaataaatatatcggttttcatacaattaaagaatatttagataaatataaatgtcctttacaattttttgtcggtgcaccacatagttatcaatcaacagaatatttaaataaatcttatacaggtagaacaatatttgttcattctaaatatgttggtaatatagctaaagataaaaatagtgttgctttaagaaatataaaaaaagaattattatatttacaaaatatggaaataaataattctggaactgttgtacatttgtcattatattataataaaaatcaagaagaatcattaaaatatgtcgcaaatgaattaaataaattttgtaaagttttggataatatattagataataactactttaatcatataatatttgaaactacaaatgatataagacatttgggtgctaaaacagaagattttaaaatattatatgataatttagattctaatgctaaaaaaagaataaaattttgtatagacacttcacacatatttgttacattttacaatattaatacagttaaaggtatgataaattatcttgcaaaatttgatttgttaataggattagataaaattatattaattcatcttaatgattcgtgtggtttgccattatcttcgtataaaccacacgaagctattggaaaaggaaacatttttaaaaattataaagacgatcttagctcattacatattttaaaaacatatgcaacgttgtataatattccatgtatattagaaagaagaaatgaagttcctgatcaatctataatggatgaaatgaaaatatatttagatattaaacaaaatatgaatattgataattttatgtcgatgattaataagcataaaatattactagtattaaataaatttgcagatatatataatatacttaatgaaataaaatataaagcatttttaaatgccgcctatgttatacaaaatactcctgtgataatttttaaatataaaaatgtaaataataaatttatattaaacgaatctaaagaaaatataattcaaaaatataaaaatttaaaatcaataggaacatcaatttcagatataatatatgaattattaagtactaataaggttgaaaaactcattaatttagaaaataattcttcgtataaatatattaaaattttaacttcaatattatttataggtcctaaaaaagcacaaagtttattaaaattaaatataaaaaatataaatgatttaatagaaaaaaaagataatattatcaatatgggaatattaacaattcacgaaattaaaataatcgaatatatcaaagatatggaaccagttagtagaaattttataaatgatttgaaacaaaatataaatttaagtagtgaatgtgaatggtatatattaggatcatatgctagaggtttagattattctaaagatattgatatattaattatagattttactatagataaatttttagaagaattaaaaaaaatagcaaaattaatgtatataattagaaaaggtaataatatattttctggcgtatttttatggcaaggtaaaaaatttattcttgaaataaataaagttaataacaaagaaaaatatactgctattatgcattttacaggttctaaaaaatttaatatttttatgcgtaatatagctaaatctgaaaatatgatattaaatcaatattcattaaaaaaagataatgtagaattacctataactaaagaagaagatatatttgattatttaaagataaaatacataccaaataataaaaggaatatt

SEQ ID NO: 9 - DNA, 4152 bp, Amsacta moorei entomopoxvirus
atgtattttaatattttaaatggattattatggaaatattatattataaaaagaaaaaaatatatttatgatatgttagaatatttattattaattttgttttttacattactatatagttttaaaaaaaatataaaatattatgataatgatttgaataatataaataaaattaataataatacaaatattatatattatccaaaaagtaatatatctataaaaattatagaaaatgtagccaaagaattaaaaataaataaatattatggttcaagcaacgaaaatgaaataattaattttattgatactaatgaaacaatatttattttatttaataatacatgtgaaaacttattatatactataagatttaataataatgaaaataacgatagattattaattaatatacaatggttaattaatatgaattatttaagattgttatcaaataaaaatataaacattgatatagatataaatgaatacatatataaaaattttaacacaaatatattattttatacatattattcgatattaattattgcatttatatcatttatattaaaaaataacaacgacaataatgatcctatgttcaaaataataaaagtgccaaaaatattaatatatatatccaattttatatgttcaataccatttggaattatttattcagtatttggtacaataatattaacaatatcagaagatccgttaataaataataataataatattataatgtttctaatattattaatatattttatttccgtaatttctatggcttatttgtgtaattttttcatattattaatatacaaatataaaatatttgttattatgtgtgtgtatgtattaactattattcctattacattatataataatttaaattcagatataaatatatttataggtttaattccacacattcctttatattggatttttgaccaattaaattatgtagaaaaacaaaataaaagtttaacatttaataatattaatatatcttatagtatatatagtaaatctatcttgatatctattatatatttaattttgcaatcatttatatatatatctataatacatataattaaattaatatataaaatatgtaaaaaatatatgaaaatgaaatatatatatattataaatgaaaataataattatatgttagaaacagaaaataatgattattatgttaaaatacaaaacatatataaatattatgataataattttattttgaataatatatgtttggatataattaaaaataatacaacagtattgttaggaaacaatagtgctggaaaaagtactttattatctattatattcggattaataaaacctaataagggtaaaatattaactaataatatcaaaataggttattgtccacaaaataatataaattttacagattttactgtaaaagaaaatatatatttatttaatatattgagaggattaagttcgttacaatcaaaaataaaaacaaatgaaataattatttatctaaaattacatgatatagaaaattgtataataacagaattatctgaatgttcaaaacgtaaattacaattagctttttcgttaatagatgattctgattttatattaatcgatgaacccacacataatatagatttaaaaagtaaacaagaaatatgggatttaatatcattattaaaaagaaataaaactatattaattactacacattgtatagatgaagttgaattattagctgataacttaattatattaaacaacggaaatgttaaatataattcgacattatttaatattaaaaaagatgcaaatgtaacttataaattatcaatacataataattctaccgacgataaaataaaaaatataattattaatagtggatttataatattaaatattaataaaatagatgaaaataattcaatatataatatttataaaacagaaaattctaattttttaaaattgtttgaattattagaaaatgttaattgcgatataatatattttaaatcgaatactttaaatgatattttatataaattatgttctgaagatattataattcccgatgatagttatataaataatttaaattataatgatatgtttatatctgaaataatgggatttaataaaattatgagacaatttatagaattatttaaaagaaatatttattatataagaaagaatatattattatttgttattataaattttattttatctatattaattgtttatgtgggtattgtatatattaaaaagtatgaaaatttatatttatataattttgtaatcataaatcacaacatagataattttattaataatagtaattatttattagatataaaacataatagtacatataataaaataacttatatacctttatttaaatattctggatcaatagccattaacattatttcaaacataatagcaaaaataaatataccaaatatagaaaaagacataataacaactatattttatccaatgtatcaaaataaaactagtattttaactaatttatttatttcaattatattacaattatattgtattaattataataaattaattaaaaaagataatataaacaaaacaagaaaacaacacattataaatggatgtaatcctgaattacattggataacaacattattatttaatatgatattattttctatatcagtaataccaataatattatatatgttaaatattaaatcattttttgatttaattatattatattttatattgataattaatgcattatcatttatgcttttttcgattataatattaatgtttgataatcaatccgataaaataatattaattttagtatttatattaggcatactattacctatatataaaattaaatataaaaatattattttagatatattatcatatatatttatacctagttgtatatcaatgtctataattgaatatttaaatacacacaaactaaattatataatttcgattataatacaaattttattatatttaattttaattatattaatagaaagaggtttaattgatataatatataataagataattaatttaaaatataatagaaaaaataataattattttgaattacaaaatataaacaaatatactgactataattcatcattaattatgtcaaatgtttataaaatatataataataaattggcattaaataatataaattttaaaatatcagaaggaaaatgttttggaattattggtggtaacggatgtggaaaaagtactatttttaaaatattatctggcgaagaatgtgttacaaaaggaaatatttatataggatgttctaacagatcatggatattaaaatcaaattattttaaaaaaatatcttattgttctcaattttttggcatagatacatttttaacaggaagacaaaatttaaaattaattatgatattaaatggttttagtgataaacatatacaatattatattaatatttggttaaaattattaaatatagaaaaatatgcagataaagcagtttatacatacagtactggtattataaaacgtttaaaaatagcaatgtcattagcacctagatcaattttaactttaatggatgaaccaacgtcaggaatagatattgtatccaaacaaattatatggaaaactataaaatatattattaattataattattataattattacaaacattccattttaatttcatcaaataatatagaagaaatagaatatttgtgctctaatgtgattatcctagattctggaaatataatgtataacgatactttggaaaatattaaaaatatacatagtactaaaataattaatattaaattattacattatgataataacaaaatttgtaaaataaaaaataaattaaaaaataaaggttttatgttaaaatcagataataaatttaaattaacattttgtgtatctaaaaatattaatttgaaatatagtgaattatttaaaatattatatatattaaagaataattattcagatataattgatcaatatgatataagtgatacaaatatagaacaattattttca

SEQ ID NO: 10 - DNA, 236 bp, Amsacta moorei entomopoxvirus
atgaattattacattttattatgtctatttatgttattttcatctagttataattttaaattaataaataataatatttgtaatgaagattatgatcctggaatatgtagaataggaatattagatggtattataattataatattaaagattgtaaaatatttatttatggtggatgtggtggtaacatgaataattttaataattatgaagattgtattaataaatgtttaatt

SEQ ID NO: 11 - DNA, 1719 bp, Amsacta moorei entomopoxvirus
atgaatatatatttaaaaaatgcatccaatgatacaatatcgcatctgtcaaaatttacaaatcaaataaatgatattatatcatttgatattaataattttactaaaaatgttttgattatgcgtaataatattaataatattagaactaattttgaaaatgtgtctgatgataatagtataaaaagaagaataacagaattttttgataaacaaaatacgccaaatttaaaattaggaagtataatatcaattattaaatttcaacatttaactgtaacatatgttaataaaataataaaagaaattgtaacatataaatgtaatactagagaaataaatatagtaaatttttcatctgtcacatctcaaatttcaaactacgataatcctatattaaatgaaatattaaaacaatatgtatataaacaaaaattaaaaaatgttactgttaataatgataaaaagaaaataattgatcctgatgatgagaaattagctgaatctattaaaaaaatattagaagaaatattaaaaatattattaattataaaaaacaatgattgtgttgcttatgggtcatttacttgttataatataaatagaagtataaaatataatgatatagatttatatagtactgatgcatatagaattttaatattttttatgatatatatacatttaactattggacatgacacttgtttatttagtataccttttataactgggcacatatcgttaaaatataaaaatatatttataatagattgtatatttttagataattctattataaatgttattaataaatctttaattaataatatatattttatagatcccggtttacaaatgttaaataattttagaatgttatcagaaaattttagatcttataaaatatatgaaaaaatggaagaatctttaaataaatataaaacattattaaattattttgttaataataataataaatttaataaacaaagattaaattattggttaaaatcagatgtttgtagaaataattttccatatactatagtcgacaatacaatattaatatcaataaaagaattgatagatataagtccatatgattatataatgattgtattagattcgccgtcagacataatggaaaaattatctaatattagtggactatttagtagaaaatatggtgcttttttaaatgaaatattttttgaaacaaaaaaaataaaaaataaaataaatacatatgctggaaacacaaataacataacacaattaattgatgaaaataaattaataaaattaaatagaagtgatataaatatgccatataatattaatcccaataagaaatatttaattttcagtaatttaacaacatctacgtatgtttactttgagaatgataaaatgactgatatatcagtaaaaaatctaatatcatttatatcaacagcttgtttatataatttgttacacaaaaaagatgattttggtatggaattatattatttaacattacactgtcttacatttaccgaaactagaaaattaaatgaatataaagtaatagatagatataaaataaaaggcgaacataaagaaatatcattgtgtaaaaatttatttaattcaatatataaaaataaaagtatggaggacgaatatatggattataatacatttatagatttaactaatataaatggaggatat

SEQ ID NO: 12 - protein, 286 aa, Amsacta moorei entomopoxvirus
MTIFEILIWIIVLLAFMFIIFLYVVLYIKRRIYEILNENIPIEINIDNVNYPSELYTDKFNPNVLKYLIKILLDFNTEITNNIIIHSIDYMKIYYISYNKKKIIKLILDRYNNLWIVIRGTLTYNEFEHDLRISQVKIDNCDMKCHKGFCEIYSKIQKPLLNLLMTLSPNKIFALGHSLGGGILSIAAYDIFNILNKKEIILYTTGTPRVCNKDFYNNCNKYNIHKVENLSDVYINAIPSVLPFYDNTVYYKIGKIWYFDVNYGNIILHKLEIYFNNIDNLKYLEI

SEQ ID NO: 13 - protein, 151 aa, Amsacta moorei entomopoxvirus
MKAICVMTGKVNGIIYFIQNIKGGSVHVKGKIVGLSKGLHGFHVHEYGDVSNGCTSAGEHFNPYNRQHGDISDKIHRHVGDFGNVYADENGVANIDFHDDIISLCGTNNIIGRTLVVHDSPDDLGKTDPLSKTSGNSGGRLGCGIIGIAKD

SEQ ID NO: 14 - protein, 453 aa, Amsacta moorei entomopoxvirus
MYNNEYFTNRVKIHKKIDTINKNVLYLAYRDLRVYDNWSFLYSQNIAYLNNSSMYVLYLINKNNNINIRQYKFLYEGLPEFESQCKKCNVSFHLLSYNNNIISNFINKYKIGHVIIEQMPLLFHKKYYLDPLKKLNVNVYIVDSHNIIPVWVTSDKQEYNARTIRIKINKLKDQYLIEFPKVKISNIQPIFVENNFDIIPNYDKKLINIYEIVGGYTNGINRMNNFFKNKINTYKDKKNNPNYENTSILSPWLHCGMISAQRCVLEANKLKKIKDYNIESIDSFIEEIFIRKELSDNFCYYNNNYKSFASCPNWAILTLEIHKTDKRNKIFSLRELEYGKTDNKLWNYCQYYLLKFGYLNGYMRMFWAKKLIEWTNSPQDAIDKTIYLNDKYFFDGYDPMGYVNILWSIGGLHDRAFKEREMYGKIRFMSQPLMYKKLNVNDFYNNFDNVIKS

SEQ ID NO: 15 - protein, 263 aa, Amsacta moorei entomopoxvirus
MMDDINLYNESERLQTFENWPINFITPESFASNGFYYIGENDTVKCVYCGVQINKWVEGDKPEIDHKKFSPNCSFLKSNDGIDECGNNKNISNITQKGAVHPNLSNIVERLKTYKEWPISMPISTEKLEAGFFYTGKSDKVKCFYCDGGLNKWETDDDPWIQHARWFDKCDYVKLVKGKDFIQKVMTQSTFIKSSKKENIPEINISNDEKNDIKLCKICYIEERVICFVPCGHIFCCGKCAISMDKCPVCRNKIKNLTRVYYP

SEQ ID NO: 16 - protein, 295 aa, Amsacta moorei entomopoxvirus
MNFMPQYYYISDINNEIEYDENFNPGKKFDFKRQGQIKLLMNEIRFLTEDVELHKNYKNENINILYIGSGKGYHIPLLINMYSDYKIQWDLYDPCGHCEKLYNIQKNNNNIKIYDTYFNKSDVEKYENIDNLLFITDIRTVDNPDDEPNTKNLINDYELQNYILKELKPISLVKQRDPFPNDWDDSYKLSIPDGKEYIQCFQKYNSAEYRIFISGITTFVDINSVILNKRGIDRKLAWYNMKYRFQNDNDYKIAYRILNKYIKSENKPILKKYNNINKNNIKNVIRSLSKEMGYY

SEQ ID NO: 17 - protein, 292 aa, Amsacta moorei entomopoxvirus
MDVNKYIYEYNKPLYYTYYDLCRNMNDVIYDYNNNTIKKYMDILLSQIQFLSNINIKKICNNTNGIVNILYIGSSKAYHFNILNELYKNLTNIQWYFYDIIDPCISVERLSYNIIFNRLFTEDDIIDFKDKYPLILIYDYDDKSNVRDLLYHYNMQNNIIIYLNPTYSLLKFKYMPINKWNNSFNDYEYISTGIKYLPTIKSLHTRNIIDNKNIMTLTFDEIESENYYEKMNYYNNCSGYNDIYNNISGYILNKSNLYDNNNSAYNILKIYEKNIINTINEDKIFRSKEKYI

SEQ ID NO: 18 - protein, 1089 aa, Amsacta moorei entomopoxvirus
MPFLGTGILKFDITQLQNKEKGSDYNAIRYLKRILNKPCDNDDILIPYDKLESKEINIIYNWYIIKPSSLEQFIVCKCKDYDTEEIIYILFDIYEYFLCDYELSESNTKLKNIKNNIKYKNSFNSSYLVLEDYKIITNEVNIQYYYNYTEDSKITLNNNDLVLFMTPYKIEKIYSKNIFINQYRWFYVLNNIEPSGSYRINMDNMQKIKTYNKNKTSYYCKNPKLLFSNYVKIDKIPASRVSIDIECQHFGEFPTANKFPISHICIDWYMDKNTNPIKKIITLINYEIIKNYVGKKDKFIYTEVNKLLNTNKVYITIYCTEKYMLHFVLYTLRQDFDYVLTYNGHNFDFTYIQRRKINKLKGLCLDNVYSTNEIKISKFSYNQDTTYEIDSTNGIIFLDLYNYIKKTYPSSNYKLSEITKERFNIFCKISYNNNEYIIEPLNTKANKNKISIFYDVIRTANYCFINNNPYKKNKTEIIDDIEKLYDLTSIKNSHNKKFTIYENDIPINDNYATVMLSKDDVDIGDKNAYVFTKEKSDNIAYYCTHDTVLCNCIFKYDMIHDKIIAFSNEYLLPQCMAFKYKSSNNISGLLKTLYSNKTMIYPGNVEFEKFEGGYVIEPKQKYIDSLTAVFDFNSEYPSIIIEANLSPEVVKVIKLFDDEEAANKVEKYLKDNYKYPDYCYIKIIKDKMYKFILMDRRELGVTTQMVKGREMKNMYKDLKNKNKDNVDLHNFYSSALYSKKITINSMYGLSGSERFIFNSPYCAEYCVQGQNCIKYIQTLVNNSKYIDNVLILNKCNNPFTNEPIKTNYPGNLNVNFTFNVKYGDTSLFITVNFESKFNSKEEKVKVGHKCFTFLGNVINDKKNKILTDNFEFEYEKMYYWMILLKKKYIGEVVINMDPLQLMDDTKGTALIRRDCTVIHKTILKNTINILKDFLTNDNTGININVKINDYLSSAFKNIIENIQNLDINDFKKSVKYSGVYKDPNYPIELCVKEYNLKNPNDKITKGQRFDFIYAHKINEWSKDKKWNIKYTIDISKHVIILEDYLKNKNNYRICVEKYIKDILSNLDQIINDKNIIKNIDIMLNSYEPQ

SEQ ID NO: 19 - protein, 611 aa, Amsacta moorei entomopoxvirus
MNDIDKNNILNNKYIGFHTIKEYLDKYKCPLQFFVGAPHSYQSTEYLNKSYTGRTIFVHSKYVGNIAKDKNSVALRNIKKELLYLQNMEINNSGTVVHLSLYYNKNQEESLKYVANELNKFCKVLDNIDNNYFNHIIFETTNDIRHLGAKTEDFKILYDNLDSNAKKRIKFCIDTSHIFVTFYNINTVKGMINYLAKFDLLIGLDKIILIHLNDSCGLPLSSYKPHEAIGKGNIFKNYKDDLSSLHILKTYATLYNIPCILERRNEVPDQSIMDEMKIYLDIKQNMNIDNFMSMINKHKILLVLNKFADIYNILNEIKYKAFLNAAYVIQNTPVIIFKYKNVNNKFILNESKENIIQKYKNLKSIGTSISDIIYELLSTNKVEKLINLENNSSYKYIKILTSILFIGPKKAQSLLKLNIKNINDLIEKKDNIINMGILTIHEIKIIEYIKDMEPVSRNFINDLKQNINLSSECEWYILGSYARGLDYSKDIDILIIDFTIDKFLEELKKIAKLMYIIRKGNNIFSGVFLWQGKKFILEINKVNNKEKYTAIMHFTGSKKFNIFMRNIAKSENMILNQYSLKKDNVELPITKEEDIFDYLKIKYIPNNKRNI

SEQ ID NO: 20 - protein, 1381 aa, Amsacta moorei entomopoxvirus
MYFNILNGLLWKYYIIKRKKYIYDMLEYLLLILFFTLLYSFKKNIKYYDNDLNNINKINNNTNIIYYPKSNISIKIIENVAKELKINKYYGSSNENEIINFIDTNETIFILFNNTCENLLYTIRFNNNENNDRLLINIQWLINMNYLRLLSNKNINIDIDINEYIYKNFNTNILFYTYYSILIIAFISFILKNNNDNNDPMFKIIKVPKILIYISNFICSIPFGIIYSVFGTIILTISEDPLINNNNNIIMFLILLIYFISVISMAYLNFFILLIYKYKIFVIMCVYVLTIIPITLYNNLNSDINIFIGLIPHIPLYWIFDQLNYVEKQNKSLTFNNNISYSIYSKSILISIIYLILQSFIYISIIHIIKLIYKICKKYMKMKYIYIINENNNYMLETENNDYYVKIQNIYKYYDNNFILNNICLDIIKNNTTVLLGNNSAGKSTLLSIIFGLIKPNKGKILTNNIKIGYCPQNNIFTDFTVKENIYLFNILRGLSSLQSKIKTNEIIIYLKLHDIENCIITELSECSKRKLQLAFSLIDDSDFILIDEPTHNIDLKSKQEIWDLISLLKRNKTILITTHCIDEVELLADNLIILNNGNVKYNSTLFNIKKDANVTYKLSIHNNSTDDKIKNIIINSGFIILNINKIDENNSIYNIYKTENSNFLKLFELLENVNCDIIYFKSNTLNDILYKLCSEDIIIPDDSYINNLNYNDMFISEIMGFNKIMRQFIELFKRNIYYIRKNILLFVIINFILSILIVYVGIVYIKKYENLYLYNFVIINHNIDNFINNSNYLLDIKHNSTYNKITYIPLFKYSGSIAINIISNIIAKINIPNIEKDIITTIFYPMYQNKTSILTNLFISIILQLYCINYNKLIKKDNINKTRKQHIINGCNPELHWITTLLFNMILFSISVIPIILYMLNIKSFFDLIILYFILIINALSFMLFSIIILMFDNQSDKIILILVFILGILLPIYKIKYKNIILDILSYIFIPSCISMSIIEYLNTHKLNYIISIIIQILLYLILIILIERGLIDIIYNKIINLKYNRKNNNYFELQNINKYTDYNSSLIMSNVYKIYNNKLALNNINFKISEGKCFGIIGGNGCGKSTIFKILSGEECVTKGNIYIGCSNRSWILKSNYFKKISYCSQFFGIDTFLTGRQNLKLIMILNGFSDKHIQYYINIWLKLLNIEKYADKAVYTYSTGIIKRLKIAMSLAPRSILTLMDEPTSGIDIVSKQIIWKTIKYIINYNYYNYYKHSILISSNNIEEIEYLCSNVIILDSGNIMYNDTLENIKNIHSTKIINIKLLHYDNNKICKIKNKLKNKGFMLKSDNKFKLTFCVSKNINLKYSELFKILYILKNNYSDIIDQYDISDTNIEQLFS

SEQ ID NO: 21 - protein, 79 aa, Amsacta moorei entomopoxvirus
MNYYILLCLFMLFSSSYNFKLINNNICNEDYDPGICRIGDIRWYYNYNIKDCKIFIYGGCGGNMNNFNNYEDCINKCLI

SEQ ID NO: 22 - protein, 572 aa, Amsacta moorei entomopoxvirus
MNIYLKNASNDTISHLSKFTNQINDIISFDINNFTKNVLIMRNNINNIRTNFENVSDDNSIKRRITEFFDKQNTPNLKLGSIISIIKFQHLTVTYVNKIIKEIVTYKCNTREINIVNFSSVTSQISNYDNPILNEILKQYVYKQKLKNVTVNNDKKKIIDPDDEKLAESIKKILEEILKILLIIKNNDCVAYGSFTCYNINRSIKYNDIDLYSTDAYRILIFFMIYIHLTIGHDTCLFSIPFITGHISLKYKNIFIIDCIFLDNSIINVINKSLINNIYFIDPGLQMLNNFRMLSENFRSYKIYEKMEESLNKYKTLLNYFVNNNNKFNKQRLNYWLKSDVCRNNFPYTIVDNTILISIKELIDISPYDYIMIVLDSPSDIMEKLSNISGLFSRKYGAFLNEIFFETKKIKNKINTYAGNTNNITQLIDENKLIKLNRSDINMPYNINPNKKYLIFSNLTTSTYVYFENDKMTDISVKNLISFISTACLYNLLHKKDDFGMELYYLTLHCLTFTETRKLNEYKVIDRYKIGEHKEISLCKNLFNSIYKNKSMEDEYMDYNTFIDLTNINGGY

SEQ ID NO: 23 - DNA, 50000 bp, Amsacta moorei entomopoxvirus
atttttttaaaatgaaaaaaaaaaatatcataactactaactatggatttacctatagaaattttagaaattatatttaattatacagatacatacataaaattataatttatatatttaaaatatttagaatttattgaaaattagtaaaattagattgttctaaaacatatattgattctctaaaaggaatacattatcttactaatttacaaaaattaattctttaaaagaaatatgttgccttaataatattaaaaaaataaattgttcatatacaatcattgattctctaaaaggaataagtcttaataatttagaagaattatattgttataatataaaaatttattctttaaatataataataaaaaatctgcttattaaaaatattaaatggttataaatacataaattaattattttatataaattattgttaaacatttatattaatattctaatattaaaaattgaaaaaaaaaataattatgttaaaatggagttacctgtagaaatgttagaaattatatttaattatttagataatgatactaaattacaatttatagattcaaaatgtattatatcaaaacttatatataaattaaaatataattcttgtttaaaagaaataaagaattttattaatttaaaagaattaatatataataattattatataaaatctttagaaggtattgaaaattttactaaattaataaaattatattgttacaatacaagaatcgattctttaaaaggaatagaaaatctcattaaattaaaagaattatattgttttaatacaaatattaattctttagtatatttaaaaaatcttattaatttaacagaattatattgttttgaaacaaatatttattctttaaaaggaatagaaaatctcattaatttaaaagaatttgattgttcttatacactaatagattctttaaaagagataaaaaatcttattaatttacaaaaattaaattgctcacatacaattatttattctctcgaaggaatagaaaatctcattaatttagaaaaactagattgttcttatacaagtattaattctttaaaagaaataaaaaatcttattaatttaaaaaaattagaatgttatgaaacaaatatttattctcttaaagagttacaaaatctaattaatttaaaaaaattagattgttcttatacaaaaattaattctttaaaagaattacaaaatcttattaatttaaaaaaattagattttcataatacaaatatttattctttaaaaggaatagaaaatcttattaatatagaaaaattaaattgttcaaatacaaatattgattctttaaaatatttagaaaatctaaccaatttaaaaaatttaatttgttatggtataaatatcgattttatcgaaatattaaaaaatttaattaatttagaagaattagattgttctgaaacaaaaatagtttctttaaaaggaatagaaaatcttattaatttaaaagaattagattgttcttatacaaaaattaattctttaaaaggaatagaaaatcttattaatttaaaaaaattagattgttcttatacaaaaattgattctttaaaacaaacaaaaaatcttattaatttagaacaaatacattgttatgttacagaacttgattctctaaaaggaatagaaaatcttattaatttaaaaaaattattttgtcataatacaaaaattaattctttaaaaggtatagaaaatcttattaatttagaaatattatattgtaataatacaaatattatttctttagaaggaataaaaaatcttattaaattagaagaattatattattttaatacaaatattatttattaataagtttattatttatttatagtatatacattaatattattttttaataataaataatgccttctgtacaagatattgataattctattgttaataaaatacaaaatactaatgagattttagaaaaaattcttaatattttaactgaattaaaaacagaaattaatagaaaaaatgatgatgaatattctgatttatatgattcagaataattaataagaatcatattctatacaacaatcacaacaccatgcttcaaagatagaaaatccacaatattcacattcataaatacaaacacaatttatatcttcatatccacattcttcacaaatatccatgttaaacatttttattttatatatttatttttcaatatatttataataaatgaatgctaacgaagatatgttaaatgaaatatatattaaattagataattattctttagtttatgataaagatttaattaacggaatagcaaatgataaaataaataaagaatctaataattataatttattaaaatctatggaagattgtaaatgtttaatagaaatgtcatataattatttatcaaaggatagtttattagaattaattaaaaaattattaaacgaaaatacttttttaaaatattatattcaacaaaacaaaaattaatactttattttttctaaaatacttttacaatctgtattataataatctttaatccaaatatatttattattttgttcagtacaatatataatataattatcttcttcaaaacaacacatagaattagataatttattacacattaaaggattataatgtattcctggaattaaaatatttttattacatctatgacaataattaccagtaatatttttatactcagattgtgttatgcaagtattattatatctaacctcgttattattacacgatttcataattaaattattatttatacaatcgtaatatatatcacagaaatacttactttgtttcggctcacaacaaataataaatgaaggtattaataatattaaccaaaacataactgttatattatatttttatttaatatttcaattttaagtacaatttcttatattatttttaaacatatatattctttcttcgtctatttcatttttatcattataatattctatatatggaaatgtataagaatttaatataaaatcatgtttataaataaatatatgacttaacatatgatacatttcatactttaatctacttaaaatttttgtttttaagttaattattattttattattttttttatacataaagccgaaattattattattataattacaatatatgtctatgttataatttttttcactattataaaacataatattataattttcatacattttaaaactattttgtatttctcttgatctgatattatcacaattatttaatctataataaacattaactatattatcgtaatcattacacatttcatcaattatcatcattttcatattatcttttactccacatctatcataatctataatatctgttatattcatattatataaagaagttattctacttcttgctatttcaaatattttttgttcttctgaatttttatttatatatttattatagtatcttataatggcatttttaaattcatcatcatacataacattcatattattagaatatatatttttaatattatttatagttttactatcattattatagttactttctttttttgcaaaaattatataacaaattaatataataattattattaataaaattaaaattattgatatgtatatatattttttataatcattttgaaatgttgataatctattatttattaaattacgttctacgtccatgattattatattataaatttattttatttttcaaaataatatataataatatgaaaaaaaacatatttataaaaataaatcattatggattttataaaattacaagatatagcaattagaagtataactgatttaaatattttacctataggtttaagaaaaaaaataaataaaaatgtgtgttttaattgcaaatgtatgttttttaataataatcaaataatttgtaattattgtaaattattatgttctggatgtaataaattatataataatttatcgattaaaaaattttctacaaaatatggttatagatatgaaaataaaaaatttaatatattattatgtgatatatgtaaaaaaaatacagaaatatgtattgagtgtcataaattattatttaattataataatattgattatgtagaattaagaaatatagatagtattcaagataaagtcggagtatgtaaattttgtttaattaatattttatgtgatgaatgtaatagatatttaacaactaattatataaattcatataataaaaataattatacgttatttagatattttaatgacgaatttaataattataattataaaatatgtattagagagtatatataaaagttatttattcttatttttattataaaaatttttatatcgatcaataatatcgtaatattcgttattagatattaattttgttatacattttcctgttaaaatatcaaatgttacaatagtttttttgttatcttcttttattaataaagccatattgtgtatattaattttaacatattatttcaataaaaatgttttatacatttgttttaaataatctttagaatttgtaatatttgttgattttatagtagattcatctagatttatagaatctgtagtatctgttgattttatagtagaatcagttggatttattaaatctatagaatctgtagtatctgttgattttatagtagaatcagttgatttaatagaatctgtagtatttgatactatttcacttaaatctgttgattttgtagtagaatcagttgatttaatagaatccatagaatctgtagtatttgatactatttcacttaaatctgttgattttatagtagaatcagttgatttaatagaatctatagaatctgtagtatctgttgattttatagtagaatcagttggatttattaaatctatagaatctgtaatatctgttgattttatagtagaatcagttggatttattaaatctatagaatccgtagtatttgatactatttcacttaaatctgttgattttatagtagaatcagttggatttattaaatctatagaatccgtagtatctgttgattttatagtagaatcagttgatttaatagaatctatagaatctgtaatatctgttgattttatagtagaatcagttgatttaatagaatccgtagtatttgatactatttcacttaaatctgttgattttatagtagaatcagttggatttattaaatctatagaatccgtagtatttgatactatttcactaaaatctggtggattttaatagtagaatcaagttgatttaatagaatctggtaagtatttgaatagtatttcagttaaatctgttgatattatagtagaatcagttgatttaatagaatccgtagtatttgatactatttcacttaaatctgttgatttaatagtagaatcagttgatttaatagaatccgtagtatttgatactatttcacttatatctgttgattttatagtagaatcagttgatttaatagaatccatagaatatgtagtatttgatagtatttctcttaaatctgttgattttatagtagaatcagttgatttaatagaatccgtagtatttgatactatttcacttaaatctgttgattttatagtagaatcagttgatttaatagaatctatagaatctgtagtatttgatactatttcacttaaatctgttgattttatagtagaatcagttgatttaatagaatccgtagtatttgatagtatttcacttaaatctgttgattttatagtagaatcagttgatttaatagaatccgtagtatttgatactatttcacttaaatctgttgattttatagtagaatcagttgatttaatagaatccgtagtatttgatactatttcacttaaatctgttgattttatagtagaatcagttgatttaatagaatccatagaatctgtagtatttgatagtatttcacttaaatctgttgattttatagtagaatcagttgatttaatagaatccgtagtatttgatagtatttcacttaaatctgttgattttatagtagaatcagttgatttaatagaatccgtagtatttgatactatttcacttaaatctgttgattttatagtagaatcagttgatttaatagaatccgtagtatttgatactatttcacttaaatctgttgattttatagtagaatcagttgatttaatagaatccatagaatctgtagtatttgatagtatttcacttaaatctgttgattttatagtagaatcagttgatttaatagaatccgtagtatttgatactatttcacttaaatctgttgattttatagtagaatcagttgatttaatagaatccatagaatctgtagtatttgatagtatttcacttaaatctgttgattttatagtagaatcagttgatttaatagaatccgtagtatttgatagtatttcacttaaatctgttgattttatagtagaatcagttgatttaatagaatccgtagtatttgatactatttcacttaaatctgttgattttatagtagaatcagttgatttaataaaatccgtaatatctgttgattttatagtagattcagtaaattctattatttcagataaatcatttttctttaaatattcattaatattatcaatatttttttcatatttttttaatattttatatatttcggttatatttctttcaatatcatattcatcattattattagttatattatgatatattattatagttgtaaaaacaaataatattccaaaaagtattttacaaatttttttgatattcatgattgtttattttattaatttattattaaaaattcaatttttgaaaatatatcattacaattaatataattatacaagatgttgagaatagaattaaaaaaaaattattctcataataattatgcattttgtaaattatgtaatcttatgatgatgaatgtaagaggtctaaaaatacattatactagagttcataatactaaattattattagtagataattatcctacatttgagataatattaactaataaacaagaagaatattggagaccatggatataataatgtctatatttataaaataaatgaataaaatacaagttataggttttaataatttaacactacttaatatacaaattttatctattaataaaaaaacttatgcaaaaattacaactatagaaaataatagacctcattgggtgtttgatttatatttttatataaaaataacacgtttttttagaacaatatacgaatatagtatatatggtactgttccaatagaaaataacgaaagatatataagaatatataataatactacatttaaattatttcatgctgaaccacttgggagattattaatttatgataaaaatggtgaattattatttcctattaacgttatatatatttggaatttagattctttaaaaatagttgattatgctatactaacattaaataatatatataatttatttttgtattttgttatatttataatgtttataatatattatttatatatttatataaataataggaaagatgttttgaaaaaaaataatatacattaagatctatttcttggtattatataatatatacaatatgtcagttaataatattaataattatgataataaaatatgtatcgattgttataataaatataaaaatgaaataaataaaaaaaaaatacaactacctgatttattaattttatttataggatatttatttgtattattatcaatatttttaacattatatattataataactttgtgtatagaaaattttaaaatacaatatataatattattaatatgttatattttaattatgataggtatatattcaatttatgctgttaaaattgataaaattgaaaatgcaacaatatctttcttaatagatgtttgtaaaaaacatagacatagacgtagtagtttacctacttatgaatcattatggcctgatactgtttaataaaaataatttattatcttacgctttcatatatatgaaatatttttttaatgtaaataaatcttaataataatattattaatattaatattattaatattatgatactaggtattaaatattttgacattagtcctactttattaaaatctctgatattatcatcacattcataaattatattagatgaatttattactgtatcaaagtttaaaacatcccaaaatatatattcgttatcattaattttacatatataatcatcatatttacattttttattataacaagacatagatacatttttatttttagaatcataaaatatatttattctgcgtataatatttatttcatatttcgtatttatattattgtttccgtataattttttatatttattagttatatatattattttatctatgtgtatatcatatccatctatagtaatattattattatttactatatgattttgtatttttattttatttaaacaataatcatattcattacatataatttgactaaaaatagttataaatccatttattattatatacttgtccatgattatatattaatataaatatgttttttcaaaaaaattattatttttttataacatagattaataaaaatccgtattttttatataatttattatatttgttaatatatttttaaacacatcattgaaattatcatctattttatcagattttatatgtttaaattcatctttagtataataaaataaaatatattcgttatcatatttatgtatattttcatacatttgtgttcctttttcatctccatacatttttttatagaaatttatattttttatataacgattaggaggacaccagtcacctttttctattatataatttccgcttttagtgaaataatcaacatcataaccattttaaattttacgtttatttcttaaaatatataaatcttcttcgtcgataagtttaatacattttatgacaatatctaatgttatattatcagaattttcttttatttttataatttcatctatatattcatctacgtaagaagacatagtgttttatttgttttatattatttcaaaaacaaatttttatgacataacaatataatttgttttatatatatgcatttgtctttaaaagattttgtaatcctcagaaagaattaaattttgtattttgtattaaaataaacatccacgagactcatctcaagaataatattctatcattaattgtaaaatataattttcatcaaaattttatatatccattgaatcattcatacatttattaattgtaaatttatattatctatttgattaaaatttgattttatatattctaaatcggttttatttcagaacataaatattcgttagatataaaattattataatttatttttaaaacttcttctactatttcttaaaattcagcacattcattaaattttttttattattaataaaactatatttgtgtgaatcgaatttaatatagatatttcactatttttatcttcggtatcatatatctttaacagttaatatatattttatttttgaaaatattaattttttttgaaaaataatatattattattaactaagtatattattatacaaatatggatttttcaatattaaaaacaataaatttctggatagaaattttcattttcataatatctgtatctggatcaataatgatttctctagcaaattttaatggtttatggttatggataatctctaatatatcatctattgcatattttacatataaaaaacaatatccgttatgtttacaacaatgtgtatttttaacaacaacaatattaggtatttattataattgggataaattataaacacaatagataataattccttttacagtattatataatataatattaatttttattaatatatttaatttgtgaatatatatttttataatattaaaatacttttttattatattattataatataaatatttatcgattatgtttaatatatataaaagattaacatttaacgaaaaaatatatttataaaaaaataaataatggaaccaatatttaaatatatgtttgttacagaaaatgcttttgaacctattagacagacatcaaaatctgcaggaatggatttaaaaagtgcatatgattatattgtttcagcacatgataaaaaattaataaaaactgatttaattatagaaattcctaaaggatgttatgcaagattagctcccagatctgatttagctctaaataaatttattgatattggagctggagtaattgacgaagattatagaggaaatgtgggagtaatattatttaatcattctaatgaagattttataataaatagaggagatagaatatctcaattaatatgtgaaaaaattttatatcctaaaatgttaaaagtcgatagtttatcagaaacaaaaagatctgattttggttttggatctactggttataattaagaatataattttattttttttttattaaaaatattattcaatattaattaaaaattgtatataataaaaatattattgatattataattaataaatacattattactgtaaatatgaaaatataataacttttttgtatatatataacatttataattttattaataacgttattattatttactgtattgttgctataaatatattcttttttaattataacatcaaaagaatccgaaatattaatatttactattatattattattttgtatttttttcaactcgtgtttgcaaacatgcggattataagatatactttttgtaaaattaaaatatttacagtaaaaatctgtttcttttatataattatataattctaaattattatactttatagaaatatcacataaattattaccatttatatcaattttattatttaaattaaatccatttaataatttaatatcaacatcattacccatattgatatcatataataatttcaatatattttttggtaaatctattagaggaactgtgggtgtgttataatcacatttattattatttaaaatattttttatataatcatcttttaatatatattcattttctatacaataaatattattatcacaaatataattataaaattgtgattttataggtattttatttattttatttccatcacaatataatactggttcacatgaatatgacgaataactactatcaaataatatatatttcgaatatttatatgtttttaattcatttttaaatatatattctaataaattataatttatccattgataatcataatcatttacaattggaaatatattgtcaatatttttaacaaaagatatattattataattataaatatatttattgttattatattcagttaatatatatatattatttttatttaatataaacgtttgttctttttcatcataaaattctacaattatatttccgttacaaaatgttttaaatatatcactatatttattaattttatttaaatatttattcttaatataatcaggatttttatgatttttatatgttttggtattaaaatttttttcacaatattcaatatttttttgtctccatatattaaattctatatcatgattgtgtttaatccacgagtgattatattgatgtgttaatattttttttataatatttggataatgatcaaataagaatcttgttaaagaactacccatataatatggattgggtgtattgtaatctgattttaaaacatctttaattgtaaaattattttttttaatatatgatagatctaattcataacattttctattaccatatgcatttgctgatccttcgatgaaccaaatagggaatttcatatcatatatcatatacattaaagcatggtgtaattcgtgaccaaaatttaatggtttattattctgcatatatgcaaatgattgtattttattgtccataatagttgtatatcctccattatttgttcttatattatatattaatccatatttttcatattgatttttattattaaatatataataatatattttatctttttttaaatttaaaggtaaatttatatatttgtgaaaataaataaaattattatacacaaaactggattctttttttataaaattaattatttctgcatctaaactatcatatctcaattcgattgtaatatttgatatattgtaaattattatatttggtaaaacatcctctttgtttattatattataataattattaaatttttgttgttcatcttttataatatgtgacacatattctatataaaatatttcttttacgactttttctgatataatataaccaggataatcgatagaagttttaataatagataatgtattattgtcaataatatttctaaattcaacattattattatgttttcttacatttttataaaagtataatattattttaattatataatcattctttgtgaaccaaataggaaatttattaaataattcttgcattatggatatatctttttttatattatcaaaatgtaaatttttaaatcttacataacaatctattatttctactataacattattaaattctattatattttctcttttaataattttattatgtttatttaaataatatatttgatatgataaaatatatgaaataaattcatctttgttataggaattataatattgcaaattattaaataaatttagtaaactttttaaattttttaaatcatttttattatcataatcatatttattttttaataaatttatatatttattatatatattaacattattacatcttggtgtattaaatttatctataatacaatcagaaattattgtatgtaaattttctgtttttgttaaggttgttatacataaaataaagaataatataaaattattcatattgaattaattattatatactatcacaatagcacaatattattatattttataataattcaaaataattaaaaaaaaaattatggtatataacctataaattttataacattaaatttaatattatattcttctcttccaatgtatttaaaataatcatccaataattcgtctacaaattttgttttatcttctttgtttaatacttttaaatgaggtaatatagctaaattaaagtcatgtaattcttttctattattaaacgtataatatatattagatatattttttattatagtaaatattccagaattattagcataatattcataattaatatcatttaaataatcaaaaggagattcaaaattaatataatattgtttccaatatggttttttaatcaattcattaattaacataacatgagttttttccattaaagcacccattatatatatgtgtgcgttatgattagatatttttgctatgtttgaaaatacaatatttttatttttaatccatggaatgcaaaagaaacttaatattatgtcatattttttatttataatatttgtaatattatcggtagtaatatccaatgttttaaattttaaattattttttatataattatttttagcataatttatcaaatcataagatttatctattcctaatactgtattatctgtaatattagataaataatgtgttattttaccatgaccacaacctatatctattattgaatcatttttattaatattaattttggatataaaagatatagatgaatcatattgaaaatttgatatatttacataatttgtatcccaacaatatgtatgtattatacataatgaaaaaataattatattaggatttgccatttatttttagtataatatttcaatcacaaaaataatataagaataaatgtttgtagtataacattttaattaacaaattgtatatctaaattaaagaatataatttgtgttacaacaatataattcttctaaattaattagattttttatttcatataaagaattaatattggtataagaacaatttaatttttttaaattaatcaaattttctattcccgttaaagaattaatattagtataagaacaatttaatttttctagattaatgagattttttatttctaataaagtatcaatttttgtatcaaaacaatataattctcttaaattaattagattttttatttcttttaatgaattaatttttgtattattacaatctaatttttttaaattaattagattatttattcccgataaagagtaaatatttgtattaaaacaacataattctcttaaattaattagattttctattcctatcaaagaatcgatatttgtattaaagcaatataattctcttaaattaataaaattttctattcctatcaaagaatcaatatttgtattaaagcaatataattctcttaaattaattagattttttatttcttttaatgaattaattttagtattatgacaatataattttcttaaattggtagtattttctatttcttttaatgaattaattttagtattataacaatataattctcttaaattaatgatattttttatcccgtttagagaattaattctactagaagaacaatttaatttaattaatttaattaatttttctagttctgttaaagaccaaatatatgtaaatgaacaatttaattcttgtaaatcaataatatattgtatttcttttaaagaataaatatatgttttagaacaatctaattttattaatttagtaaaaatttcaataccttctaaagattttatataataattattacatattaattcttttaaattaataaaattctttatttgttttaaacaatgattatattctaatttatatataagatgtggtataatgcattttgaatctataaattttaattttgtataattatctaaataattaaatataatttctaacatttccgtaggtaagtccatgtttaataattatattttatatatatattttcaatataaaaatttattgaaaatatatataaaaaataaaaaaactataaaaatgacagataataatatatttaccgtgattttaattaaacatcacatccaaagtaatattaaattcgaagatactgttaatgaaataaagaaaattaataataaaatatctgatgaagaaatatgtatattatatgctcaaactaaggtagatatggaatatttacattttaccgaagaagataatataaatatacaaattataaataattatatacatacagaaattaataattattgtattaattatttattagataatgataattttacagtagatcaagtatttccgataattgtagaattatattcataaaataatatatctaaattaaacatttattaatacaatcttcataattattaaaattattcatgttaccaccacatccaccataaataaatattttacaatctttaatattataattataataccatctaatatctcctattctacatattccaggatcataatcttcattacaaatattattatttattaatttaaaattataactagatgaaaataacataaatagacataataaaatgtaataattcatgtttaataatcaatattattattttaatataatttttcattcaataaaaattattaatctatattattttaataattacattaacaacatcagaatcatctattttatatctattttttataattttatataaataattatcatttggtaaatttaaaaatgttattgagtcattgtcaaaaaataaacaaatagtaaaaatagatttattaatgtgtgtaaatctaaatataatatctaataaaacgtgtatcaattcatcacattctttatataattttttatttcttaaaattattatatctctagataaattattaaatttatttataaaatctaaatcattattaggtatcataatttataatatatttatattattacataaaaataattattcgactgtaatttttatattgtcattatattcattagagaaatttaattttataaataaaatttttttatcattattgtatataaatccacatagatcttttataatattcgatttttttgtaatgaataattctttatctatatatttaaagtttttgttaacaataatattattatgattgtagttattaacattatcaatataacatttataatcataatcatatatattattattactattagacatagttggaataattatataattagataataattcataatcaatattaataaatatattactatttaatattttaggattattttcatttttaattatacataaaataatataatacttatttatattatttattttgttatttaataattctatacaattattataaatatattttatataatcactttttatattatttttatataaaatatttttatattcgagtataaaataatctaatttataatataatatttgtatatcattttcatttatattacatataatatttgtgtcaaaattatatacattattatctatttttttatcaaaatatttgtttatttttaataaaatactatttatataattattatgatcattattaataatatttattttatttatttttccatagaatggtatcataaatatattattatatatattaacatcattacttaatattttagttatatatgtgcattttcttttattattatctgtttttatatcaataatttttgtattttttaataaaatatcataatcattaaaacacattattaatattatttaatattttttcaataaaatttaaagatatatcataattatatataattttatcaaaattatcattaataattttaattaattcaatattttgttttttattacagttaataatcatatttatataatcattcataattatattatttttattgacataatcatcataatcagatatacaatctatgagtttatcacaattatacacaaataaaagttttaattcatatataatattaatatttttttttaatattcttattttatatttcttagaatatatattattctttattttatttatgatatatttagaatattttataaaatatttactatatgttatattgtcttttatatacatatattgtttattgttatatttatattgcaatgtagacatttccaatatattttttatatatttatccatttttatatattaatttaaaatttcaaaaacatttatttgtctaatgttattaataattttgtatatttattatataacaaatataaatattctgaagatataaagtgcattgaatttgcgttgtaatctaattttttatatttttttttaatttctatatctggataaaatttttttataaaatatttaatgaaaatctttatctgaatatttttatttttaataatatagtcatattcttcgtataatttaagtagaatattatttatatattttttatttgtattataattaatttttatattatctaaaatataatttattaaacatatattgtcaattatatttaaattatcatatttttttaaattattaatcatcaaaacataaaatatataatacatttctataaaatctccaacagttatagataaagtatctttacgctttattttttcatctattttatcatatactgttttattaataaatttatatttttcatataacataatatcatcataaatgttttgatttataatataatcatatttttttttattatttattatttttaataatattgaataacatattatatatttattattagataatgatattaatctaatcattattataaatttattttaatatattatatattttttcatgatataaaaataatatctatttattaaataatttctatttctacattagtgtttttatatattttatataatatatctttcatattatttaatgtttttattttttttaaatttttatattttttccaatctaaatttatatttttatcatgtatgtattctataatctctattgtgtcaggcaacattatattaaataaagtatcattgcaatatattattttaaaatgttttatttttattttacttagatttattgtaattatatcattacaaataatactattaatttcaaaatattctaaattatataaattatttaaaaaattacttttcttaataatttctacattatttattattatttgtctaatactaattggtaaaatacattcatttaaattataaatattattgaaacccaatgataaagtatctaattttttatatttttctaaacaattaaaattaaaattataagtagacttacaagatataaattttattatttcaattgatttacacgcatttaaaatattaatatatgaatttacaatttttattttttttaatcttattaattgtgttaaaaaataataattattaatattaaaattatttgatatttttaaacattctaatgatattggtaaatcaattataatatttttttttgagttattaaaatttattttaattttttttaatttagtatgacataataaaatatctgtatttatttcacaattttgtatatctaaatattgtaaattataatattttgatatgtcaatatctgataatttgacatctatagtatcatcgaattcatattcaattatatttgataaattttttaaataattataattttctttatatgattgataatcacataaatgagttatactttttggaaattttatcaaatgtatattattttttttaacattgaaagatatatctaatttttttaaattaattaatttttctataaatttataatcttttatttgtattgattccatatttaactcaactatactaataggaaaaacattattaaagttaccaaatttatttttagatattattaatttttttaaatttactaaattattaataaaattatagtcatttatattacatgattcacaatttaaaaattctatagaatgtggtagtataatattacttatattgctatttttgttataagatatatctaaatatgttatattttttaattttgttataaaatttaaattaataatatttaaatttgaaatatataaacttttaatattttctggaatattatttaaaatattattatcataatatattatatgcaattcttctaaattaactaatttttttaatatattaatattaataacattatctctgtttattattattttttttaaattataatattttaaaatatttattaaaattatatcagaatttagtaaatccattttgataattttatttttttttcattgattaatttttttttgaaaaaatatatcaaataataaaaaaaaatgtcgatagaattaataattggtcctatgttttctggcaaaacaacagaattgatgcgaaaaattaatagatatattttatctaatcaaaaatgtgtaattataactcataatatagataatagatttataaataaaaatataataaatcatgacggaaatatattaaataaagaatatttatacattaaaacaaataatttaattaatgaaatcaatatcgtagataattatgatattattggcatagatgagtgtcaattttttgaagaaaatgatttagaacaattttgtgataaaatggctaataataaaaaaaaagttattgttgctggattaaattgtgactttaacagaaatatatttaattctatatcaaaattaattcctaaagtagaaaaaataaaaaaattacaagctatatgtcaattttgttataaagatgcttcttttacaattaaaaaacataataaaaatcaaataattgaaataggtggacaagatttatatgttcctgtgtgtagattatgttataataattcatattaatatttttattcataaatgcaaaataatgataattattattctgatattgaaggtgcaaaatctgatatttcgttagtagatagaaaaaaaaaaataggtaaaatgataaataatattgttaatatcaataacgaattaaataaacaattatcaaataataataaaatgttaaaaaatttattagattctttaaaaaaatatgattgttgtttataaatatttaacttgaattctccattgaggatttggtaaattagtattacttttaaaagttaaaatttctattgtattatatataaaatcaggtagtttattattttcatttttaaaaatataatcgtaatcataaggttttggtatgttatcatttttataattttcaatatacaaacttgctgaaaatattattttattatctaatgttattatttttgctacaccacttaattttatattccaattaggatttttaataagtaaatcatttatttgttcaccaaataattcaagtttattattatccataatatataatatataatatataatatataatatataatatatcttataataggtgttaaatgtgtttatttattagtattttttcataagagtttataaaattcagaaagtttatttttatatatattattatcgttaaatttatacttcttgttaataaacccatatatttttccaaatattttataaatgggtacattattatctatattattcatatgaattaaatttttataatattttgtaatataatataaaacattatcttggttaatatcaatgttatttataaaatttaatacagattcttctgtaatattatataaaatatttttatgtgttagttttgttaaattgtatgattttttaactttatatcttatatttttatatctaattatatatccttctactttactttcatcattgtgattgaatacaatagatttatatttgatattttctataaagtcattgtatttaatcgtttcataattaataacattaaaaccagcagcatttaagactatttgacatatatcaaaatcaataaaatgaattttatttttattatcgcaatttttaatttcataagcataatattcaattctattatcattaaaataattaacgtttttaattattaatttattaataccttcgtcattttgataagaaccaattaattctccatatataataaatttttttaaattaagaaatttatttattttattagtacaatcgattaatttatctttaattcgataataattcatgaaatttttattttcataatatgtatatctcgaaccaaatgttataataccattattatatataattctaaaattacatccgtctaatttttcttgcacaaatatttcttttccatataataaagaatttttacaatggtttaattgttttatagaaggataaataattttattaatttcatcatcgttatttaatatttctggaatatataatggtttgttacaaattagatacatcataataatatttgatatatttttaattttttttggtttttcgagtttatttacattttccaataatacttttctatagtcttgaataatacttccttgttcttcagtagctaattcattatttaatcttttcatcattaaaatattatataattcgattttatcttcttctaataattctggtaatttattaataacgggaaaatcattattttttaaccaataatttacatatgacaaattatataataatgctaataaattttttggttctctatcagatgtattattaatttgatatttagtcatagtttttaatataagagatatataatattttgttatatatctaacaaagtaaaaaatcatatcattttttatattttctttagttccgtatatacctaagaagtaataatttcctttaattattcccataaaagctttagatatatctacaaatgttatatcgttattattttttttattagaatgtctgtttattaatcttttattatcttcgatccattcttctgcatatatatctgcagaagatttagttataataatataatcataatcactactaataatatcatatccttttgctttacttccgacatctaatataatataaaccattttggaaagtagttttaaatattataattttttttcaacaatataatagtttattaataaatgaatataaataaatgtatagaattgggatcttattttcataaatttctaagacaacaattaccacattatataataccatatactaatagtggttttaatttttctttttgtaatattgataacgataattatatgtgctgtgttagatatagaacagatattaaagttttatttggtaaaaatataatacccggtgattataaaaatggcaaaaattttgtttggggaagatggaatgatcctagatttgttgatgctacttgtatatttatatgtaagtgggataataataaattaatttttgatgaaaatataaaacctacatttatatggtctcaacctatatgcaaaccaaaaaaatgtatgttattaagcacaccattattgtcagattttagaatatttaaaaataaaaataaaatatttatgatagatggtaatgtttctataattagagagataaacatagataaaaaaaataataaaatcactataaattctggattatatttaaattatatatgcggtgataccacagattattgttatgataaaaattggtcatatgttaaacataataataataacgaattagtatttttgaattggataaaagatagttatgtattagagactatagttactatatttgataaatgtgaaactaaatgtgatactaataaggtaataaaattaggtggcaatcatattattgatggactaggtgatttaaaatcaccaatgttttcttttggaactccgtgtataaaaattaataataatacttatttgggcgctggtcatgctaaaataatgcttactgaaaaatatgaaccaaaatctaatatttttaattttagaaaaaaaatatatgacaatttttgtaatgacaaaacatacattcaacacaatagttatatatattgtatgtatttttttaaatatgttattggtaaaaataaaaaattatatatatctaattgttatttacctataattaaatcaacaaaatattttttttctatatattttcctatgtctataactaaaaataattctgatataattgtaacaggaggatacggagattattattctattgcggtaacttttaattataaagatgttataaaaatcactaatcacgatattgaaaattttaatattaatgattataattacgaattaatatattgttaaggataatacacgcgagttaagttttttattttatttcgacataccggacatttatccatcgatatagcacattttccacaacaaaatatatgaccacaaggcacaaaacaaataactcgttcttcgatataacaaattttacataattttatatcatttttttcatcgtttgatatatttatttcaggtatattttcttttttcgacgatttgataaacgtggattgtgtcattactttttgaataaaatctttgccttttacaagtttaacataatcacatttatcaaaccatcttgcgtgttgtatccaaggatcatcgtctgtttcccatttatttaaaccaccatcacaataaaagcatttaactttatcactttttccagtataaaagaatccagcttctgctagtttttctgtagaaataggcattgaaataggccactctttatatgttttaagtctttcaacaatatttgatagattaggatgaactgctcctttttgtgtaatgttagatatatttttattattgccacactcatctattccatcattagattttaaaaaactacaatttggagaaaattttttatgatcaatttctggtttatcgccttcaacccatttatttatttgtactccacaatacacacatttaactgtatcattctcacctatataataaaatccattactagcaaatgattcaggagttataaaatttatgggccaattttcaaatgtttgtaatctttcagattcattatacaagttaatgtcatccatcatatttaatataaaatataatatatgtatgttatttttttatattatttttcataatattaatcacatactttttcgtttatcgtcataattataacgatatatattattattataataatcattataaattttatatttagaaggtatgtttatttttatttctgatattttcgacacattgttgtcaattttaacttctaaatttaaataatctatatattttaaattataattatctattttattatataaaatatcatctaaaatgttataatatgacaaataattatatttatacgtatatttatctttttgtgattgtaaaaaatttaaccatttatcatgagcataatcagaaattatattaaaattataaatatatttatttctcatttctatttctacttctataagatcaattaaactaacactaggataactatgttgattatcccaataatgatataatttacaatattctttcataatattataatgtgcattacaatatttatatttagttatgttattacactgtttattatatactatagcagagcatttttttatatttttaaattttaaattatcgataaaattattaaatttaaatttatattttgaaacaaaatcaaacattttatttataatttataaaatatttcaaaaactataaatataaaatatttttacttttctaatattttttgaaaaataattattaatattaactataattataacataatggagaatgttacgtttaaaaaaattgttggtaaaaccagacaagtattttttagaagcgatggtttaaaaaataattgtttagctatatcaataataattaatgaagtttgtaaaaaatataatattaagtgtaatataattcgtaaatatatatctgaagataatattaaattttataatcattttgtagtaactaatggaaaagaagagtatgatacaacattaattccaagtaattttatttatgataaaataccatatataaataatttatctgaaaaagaccaagaatatgaatctaaattatatgaggaatattgtttatattgtgatggaaaattagacaattttattaacaaaataaaatataaatacatagataaaatatttttattacttaattaataagaaacacttatcggaaatattattcagattaaaaaatattcgtggttaattttataaaaataatcttaataacaataacgatttaactaaaatattactgaactgtataattaatataaattataaattagtttaaaatatatcattttatttaataaacaagaataatattattattgaatttttataaatataattaaaaattatataaaatgtctttaattgatgtgtgttatgaacacattaaagactcatattattatggtctctttggtgattttaaattagttatagataaaacaacaggttgttttaatgctactaagttatgtaatttaggtggtaaaaaatttaaacaatggaaacgtttagaaaaatcacaagaattaatagattatattaaaaataaccgaggtggggatccccaccccggcttttatgaaacaaaaggagataataaagatgaaaatgttaaaaaaataactggttgttatgtacccaaagaagtcattttagatatatcgtcttggatatctgtagaattttatttaaaatgtaatgacataattataaattattataatactgaatttaaatctttgtctgaaaaagaaattattaataaaattaaagaaatagaaaataaatatattaatattgtagaagataaagaattagaaattaatgatttaaataaaaaattaagtgatattataaatcaaaataataagatattagaatctaataaaaacttagaaaatcaaaataaaaaattacttaagttagcagagaaacaaaacataaaattagatgaaataggagatgaattagatgaaacaaattttaaattagatacattaactcaaacagttgaagaaaatatattacctgatagaaatatatcacctaaagacgttaatctaaaacataatttagtaatttataaaaataataacgaaattaagataattagagctcaaaataaatatataaataaaattaaaattcttgatgaaaatataattataaaagagtacgtaccgaatcctatagattttattaatcgtatgaagttatattgtgttgatataaataaaaaaataaaattaagtcttagaaagaataataaaaatatatcatacgatgaatttattgatatatataatgctgataaaaaattagaaataaaatataattatattatattaaacaatagtaaaatagatgaagttatattattatttaataaattaaaagaagaacaatataattattaataacataaattatgtataataatgaatattttactaatcgtgttaaaattcataaaaaaatagatacaattaataaaaatgttttatatttagcatatagagatctcagagtttatgataattggtcatttttatattctcaaaatatagcatatttaaataattcttctatgtatgtattatatttaataaataaaaataataatataaatataagacaatataaatttttatatgaaggattgccagaattcgaatcacaatgcaaaaaatgtaatgtttcttttcatttattatcttataataataacataatatcaaattttataaataaatataaaataggacatgttataatagaacaaatgccgcttttattccacaaaaaatattatttagatccattaaaaaaattaaatgtcaatgtatatattgtagattctcataatattataccagtatgggtaacttcagataaacaggaatataacgcaagaacaataaggattaaaataaataaattaaaagatcaatatttaatcgaatttcctaaagttaaaattagtaatatacaacctatttttgtagaaaataattttgatataattcccaattatgataaaaaattaataaatatttatgaaatagtgggagggtatactaatggaattaatagaatgaataatttttttaaaaataaaataaacacatacaaagataaaaaaaataatccaaattatgaaaataccagtattttatcaccatggctacattgtggtatgatttcagctcaaagatgtgttttggaagcaaataaacttaaaaaaattaaagattataatatagaatcaatagattcgtttatagaggaaatttttataagaaaagaattatctgataatttttgttattataataataattataaatcttttgcatcttgtccaaattgggcaatattaactttagaaatacataaaactgataaaagaaataaaatatttagtttacgagaattagagtatggcaaaacagataataaactttggaattattgtcaatattatttattaaaatttggttatcttaatggatatatgagaatgttttgggcaaaaaaattaattgaatggactaattctcctcaagatgccatcgataaaacaatttatcttaatgataaatattttttcgatggatatgatcctatgggatatgttaatatattatggtcaataggaggattgcatgacagagcattcaaagaaagagaaatgtatggaaaaataagatttatgtcccaaccattaatgtataaaaaattaaatgtaaatgatttttataataatttcgataatgtaattaagtcttaatatttgtttttatataatattgtttatataaattagatttgctacataaatatttatttcatttaataaaatatttatattctttgatgatatatcataacaaattttaataaatttttcaatttttattcttcttattagttcattcattaaaagtttgtattttctttctaaaaatatttttaaatattttttataaattttattatgatatataattaatttttttatatttttgtttaatataacttttaaatcatgtaatggtgttttgttttctattattttgttaacattatcatataattttagttttaaattattcaataattttttttgaaaattattaattttatcacacattatatataatatatagtgttatatataattataactaataatatttcagagactaataaaaataatcaatttcttttttattgttatttatccaatttattatatctattaatataataggatgtatataaactcctgatatatcgttatttcctgttataatatatttaatagtattatagtttttacatattttattaaataatatctttgttgaatttaacctataccaaaaattataatccacattaattgaatttaataatttagtaatattgaaataattatttctattatctattattacttttaaattttttatgtttataaaataaaaattatcatttatgaaattcatttttataatatataatcagatctattaaatataatcagatctatcgaaattaattatattatttcaaaaaatataattttccacattataaaaattatagtatggaacatatcttatttttctatattttactttattatgttttgttaataatgcatattgaatatatttttctgtatacatattattatcatatatttcttgtaaaatatcataatatggatcgtaattttttatatatttatatatgtttgtaatataaaatccaataataaaattattattaaaatacttaacatttatatcaaattcgcatctattatttgaaattttgatattttttaatataaaattattattatttgtaaaaatatatttaggagatgaaatatcagaataagcttcgatgtgtatatctttattaaaattatcttttattatttctatagctggaatatatccactatttttatcaacatttatattatataaattattattaatatatgtatttatatttattttgtccattttattatttattatttacaattaccaataataaataatgataatttttcacgtgtgtaatacattatatatataaataatttttaaattctctaataaattcttttgataaattttgatatctacatatataaaaccaacttattttatttttatattctctgataaattcttcagacaattgttgatattctgatattaatgtccaatctatttcatcttcatatttttttataaatttttcagataatgtttgatattttaatatattattccaagataacttatttttatatatctcgataaattgttcagataatatttgatatatagatatgtataaccaatttatattatcaatattattttgtataaaagattcagatagtttttgatatttagatatgatattccaatctattatatttttatattgtgtaataaaattttctgataatttttgatatttacatacattattaaaatttaaattatctttattttgtattataaaattttctgataaaatttgatatttagtaatattattccaatctattatatttttatattgtgtaataaaattttctgataaagattgataaatagatatattattccatattatataatttttatattttataataaattcttctgataatatgcaatttatagttatataattccaatttattttatttataaatatatttataaaattattatattttttatccaatatatcaccattttttaacatatattttgtaatggataaccaagtattattatcattatttattaatatattataaatatacttggtaaaataattaggattagataaatacaaattacataaatcaaattcatttaatttttttaatataatatatattatttcagaaggcaaatcattaaattgtaatttcattttaaaatcactaattaattattaatttaataatatttcattttgtatttataaaaatgaaaaataattataatataataatcatgtttactagtcataatatttcagattatataaaaaaatacagatatactacatataaaaatatgtataataaaaattatataacaaaaaaaattattattataaaatattataattgtaacgataaattttttaaataatttatatagcctctataataatggctattatcatacattaatactaatttttttatatctaaagtatacaaattatatataaaagtaaataattctactaaattattaaatttatatttttctagatattgtttacattgatcatgtggaaataatgatatataattaataaaatatttggaacacaaaatatacaaagttacgtgatgacataattcttttttatttcttcttataatgtttgttttagataatatattatgtaataattcgttatacaaattaacattatatgtattaataaaattttgtttctgtttattaatttcaattttttttcttattttatttattacaaaatttaatttttttgtttttgttaatgtttgtgtcggtttagtcattttttaataatatttaatttatttttataattattgatattaatatacattaataatactaatgcatttatcatttatttattgtataatatttcatatattttattaaaatttacatattctaacaaatgtgcgataacaataaaaattagataaataggatataaaacaatttaaagctcaggattctacagtattaacaaaatggcatattttaatatatatgatttttatagtctttaattttatttatatagtcatttttagtatatttatttaatctttttgcgtatacatagtataacgacaagaatagcataaaagctaatataaatatataaaatatacattttaacatatttaaaattatatattatatcaaatataatactttagtggtttaatattattaatatactttttcatacagatacaattatatattttttcattgtatgaaatactaatgcatatatttcgatcaaacaagcatataaaaatgtattatttattatctccatcaaaaataaaagaaatatgtactatacttgcaatatttaatataataatcaatattatattaatatcgatagatttagtatctttatcaaacgaaaatcacttgtgtgcaagtaaattaattataatagttattgataatgtcattcttttgttatcaatatttataaatttaatattattatgtggaatatatttagataataaaataataataaaaacatttatattaatatatattccgtgtgtaacgttatatatgattttaacatttattaaaatttatacatattctatggtttattttgaaatgatatatataataattaaaattattattaattttatatatattatgttaatcaaaatatattatgataatttgaatttattacacgattaatttattgttttctacgtccaactggaaattctggagcaggactttcaggttcaggttcgggttctggctcaggttcaggttcaggttctggttcaggctcaggccaagattctactagttcatcgtatgcttcttgtaaatcaccattcaattgttcaagatcgttaacttgaacatcggacgcaatatgaattctctgtaatttgtattgataataattggtaataactaattcgctaaatagtctagatacaagataagaccattgttctggtgtgaaattagcggatgcatctatcaatgatttaacctgattattaacatatgataaataatcgtgatcaaatgaattaggatcagctaaagattttttaatactttcggataatattttttttgtagattgatctatgttagcaataaccctaatagttttctttatcaaatcttttacaggatctactggtggtgccatttattatatataataaaaaaaattacacgagatcataaatattttttctaatgttaaaaatttattatataataatataatatttaattaaaaaaatattaaagaacttttattataaatgctgaaaaatattatagattatataaacgataataaaataaatttatattctatgaatgatttacaattagatttaaataaaaatatttttaattcatttactaataatgaattatttttatcaaaattatataatatgattaaatcaatttatgttaataattcagttattattacagataataatgctgaatctttgttattaaatcaaccttttactggaaatttaaatatagaaataccattagaaagagaatatataaaatcacttttattacaatataattcgtcagaatcatatagattagaaaatatatttaataataatatacttaataatattataaataatttatatacaataacaaatcaatattattataaaataactgaaaaattgaatgatttaaaattatctgacatagttcctgaaagaacaaaacttaataataatatttatattgttaatcctgacgagtatatttattatgaatttataaattccgaaaaatctaatataaatatgaaaaatattataaaatataatatatcaacatattatgattcgataatgttttattgttattttgacatagatataaattgtaataagatagagcatcatatttcatcagaaattaataattatactacatttactaaatttgtatttttaaaaatattgtttgtgccagataaaaaaatagagattcaaaatataaataaatctaataatatattttcgatatataatacacaatatgttataaatagatcattatctaatttaatattgagttttataaaatataaaaataatattaaagagataaataatataaagatattattatctaaatataaagataatctatcatttaatataaataatttaaaaataagaaatgttaaagttttattaaataaatatagaaatttatttaatagtgttgttcctctcgaaagttattttgcttttagatttacagtaaataatgatatgtttatatattctaccgaagatatattagattatggtgaaatagaaacaaaaatattagatatttgtccaaataagataaaaaaagctttaaaaaattttataacaattatagataatattttatataattatattgaaatatcaatatcaaatgaagaaaatgtattagataaaatgataaattattttaatttgaataaaatagaaattgacaaaattaaaaaaaataaaaatacttataatagatatttaagaatatattacttaacagataaaaaattatagtatattaaaaaaacattcaatatagcatttatcacaaaatgcatttatattttttaaatatttatacatattatattttatttctatatcatataataaaattttgtgtatatcgttacaatatttattaaaatgtaataatttatcaacgtttgatgtatgtactattacatttccagtagaaatatattcacaatctcttattttacactcgtatataaaattatttattaaaacatgagtttcggtatttttatcatatttatttaatattttttcattaatattatcatatataatatgaccatctatattacttaattctaatatatttttatcatccttaaaagctaataatgttccactattatcatattccagattcattttcaaaaatatatttttaatgtttttttatattttattttatttttcaaaaaataaataatatgggaggcagtgttgacatcgaagctagatatactggttcctctaattttcaagaaacatatttgtcattttcaaatttaattaatactatatatatattaacaagagatgaaagaataccaataggtatattttcaaacaatcctgatgattacagaaattatcgaggatatactgctatatttaaaccaggcggatataaagaattattgaaagtaaatgacttaggacccgatgacttgtgttgtatttatgattggagatatgcttgggttgatgaaaataatatattatcacaaaacgcaagtgtaaataaaaatttatttacgtgcgatcctagaactatacaagtaggaactaataatatttgtgataattcgatgtatagagcttgtatattagattttaataatcatagatatttagaagcgaaatgtggtgtttggttagatggtttatttaaaagatttgcaacagcttcaaatattataaataatacaaataatatactattacaatcgtgttctaataatattaataatgatttgtgtataaaatggttaatagcaataagaaatagcggaaatcctacatttttttcattagcagataatgttttaaacgcacaaacagataaaacaaatttaaaatgtgctttttctccttcatatattacagatacacaaaatagattaaatgttccaaaagaatgttggtatagagagtgtgctttttcaccaaattatctattattaactgacaatataacattaaaaaataattgttcattgtctgaatgtaatataaatatcggaaatttagatatagtatctgcgtcagaagtaacaataacttgcaataataataaatcaaatactgtatcatcaagacaaaaattagatatattattgagagaatcagaagattatagatttttgttaactaacaacattttaatattaattttattatttatatttttaatatttttaataattagacataattaattaaatttttaatttaagatcatataataaaatttttatatcctttattaatttatttttattatcacacatcgcatcaaataaatttaaattataattatttatactaataagtttattaataaattcattataaatataaacaaatggatattttacaaaataaatattaccatctataaatctgaatgcataatttatattatgtggtatgccataaaattttttattgatataattaatatctttgactctatatttacttagattacattcaaaagtattagtatctttattatattcataattataatctaataattctatatatttattaaatgtaaatatatatgttttacctttgttagacataaatattccattataatttttaatattattattaatatctaatttagataatccatctattattgcaaatgattcattaataatgtttatataatctgaatctatatagataattttattatcagatctttgatatattaaatttatatattcgtcgtctctaataaatttaaatgttgatttaattttatatggtcctattatatattttgatatcaaattcattttccaaaaattttcattataaaatatatataaataattatctattatagtcattgaatttggtttaatattttcatcacaaatattaatattagaatctgaagtaacaaatgcactattgataattaatatatataataatatcatttattagtttatatttttattaatatcctccatttatattagttaaatctataaatgtattataatccatatattcgtcctccatacttttatttttatatattgaattaaataaatttttacacaatgatatttctttatgttcgccttttattttatatctatctattactttatattcatttaattttctagtttcggtaaatgtaagacagtgtaatgttaaataatataattccataccaaaatcatcttttttgtgtaacaaattatataaacaagctgttgatataaatgatattagattttttactgatatatcagtcattttatcattctcaaagtaaacatacgtagatgttgttaaattactgaaaattaaatatttcttattgggattaatattatatggcatatttatatcacttctatttaattttattaatttattttcatcaattaattgtgttatgttatttgtgtttccagcatatgtatttattttattttttattttttttgtttcaaaaaatatttcatttaaaaaagcaccatattttctactaaatagtccactaatattagataatttttccattatgtctgacggcgaatctaatacaatcattatataatcatatggacttatatctatcaattcttttattgatattaatattgtattgtcgactatagtatatggaaaattatttctacaaacatctgattttaaccaataatttaatctttgtttattaaatttattattattattaacaaaataatttaataatgttttatatttatttaaagattcttccattttttcatatattttataagatctaaaattttctgataacattctaaaattatttaacatttgtaaaccgggatctataaaatatatattattaattaaagatttattaataacatttataatagaattatctaaaaatatacaatctattataaatatatttttatattttaacgatatgtgcccagttataaaaggtatactaaataaacaagtgtcatgtccaatagttaaatgtatatatatcataaaaaatattaaaattctatatgcatcagtactatataaatctatatcattatattttatacttctatttatattataacaagtaaatgacccataagcaacacaatcattgttttttataattaataatatttttaatatttcttctaatatttttttaatagattcagctaatttctcatcatcaggatcaattattttctttttatcattattaacagtaacattttttaatttttgtttatatacatattgttttaatatttcatttaatataggattatcgtagtttgaaatttgagatgtgacagatgaaaaatttactatatttatttctctagtattacatttatatgttacaatttcttttattattttattaacatatgttacagttaaatgttgaaatttaataattgatattatacttcctaattttaaatttggcgtattttgtttatcaaaaaattctgttattcttctttttatactattatcatcagacacattttcaaaattagttctaatattattaatattattacgcataatcaaaacatttttagtaaaattattaatatcaaatgatataatatcatttatttgatttgtaaattttgacagatgcgatattgtatcattggatgcattttttaaatatatattcataatttattcatataatattatattaaataatatttatttaatataatattttttttttataaaattgaaataatatattgattataaaataaatatgaatattagcaaaaattatccacagtgtactttaaatgacatatcagttaatttatttgatcatcagaaaagaattataaaatatttttatgatgtagaaacaaaaagtatagaattacaaaataattgtttaaaattaaataatgaaattataaatattattaaagattttataaatttaccatcttcgatattaactttacaaattgatattgatgatataattaaattacaaaatgaaaaatcaaaaatatactgcctaaacgattgttctggaagtggaaaatcttattctttattaggtttaataaaatattttaaaaataattacatttacacaaatgagaagttaataaacataactattataatagttccattttcattaatagatcaatggagtacatatgcatcgaatatgaatattaaatttttaatactgaatagacaaaagaatttttcatatttagaaaaaattaatgaatatgatttgataatagtatctaatacttttataaaaaaatttatagattatattaatataaataatattaaaatattacgattaataattgatgaacccgagtttataataaaaaataatataaaaatatttgatattatatttaaaaattcattacttaaatatattattccatcaatatattatgattctataatatataataatccaaaattaaatattatatatgtaaaaagcgaagaaatatctattcctttgatgaatcctacattaatatctattgatataaaaaatattactattaaaacagtattaaaaattaataataatgacgaagaattaattaaaaaatttgatgtagatacatcagatttatccgaagaaatatatttctatatatttaataaaaaaactactattattaaagatatggaaagtaatataattattaatgaaaagaatttaaatatagatgaagtaaataaaattaaaaaagaaatattatatgaaagaaaatgtattaattatataaaagaaagattattaatcaaaacttgtaatatatgtatgtctgattttcaaaataataaaaatgtaataatatgttgcattaatactatatgtgcaaattgtattcaaagaataaaagatataagatatataaaatgtccttattgcaatataacatcagataatatagaaaatttaatttttagttatgatattattgaaaagagaatgtatgaacatttaaaaaaaatgatatttccagatgatagtaaaattttaattattggttattatacattatttataaaaatagaagaattaagtattaaatggtttaatgattcaaaatattgtaaaattttgaatggtaattctactatttccaataatatgttaaaaaaatttaaacaaacagatgatataaagattctatattttgatagttatagtaaaatttgtggatttaatatggaatttgtgactgacttaatatttttgacagaaatattttcagaacaaacaaaacaaaagataataggaaaagcacaaagattaggaagaaaaaaacctttaaaaatatataattttgtattacctcgataaaataatattaattttatgtggaattttaatcacaccaacaagaaaatcaggatcggaataattacaatatataatcatatatagtaattctttataatatttatccttattatataatccttttataaaagattcaaaatatatatcatcatcttctattttttttaatccgtctgtgttataactaaaatcttcaaattcgattaattttatatatggatattcggataaatcaacattctcttcacaaagtttgtattttatattatttttatcataataattcaacataggtgaatacataccaaaaaaagttattttttcatatatgttattatttattttttttacttttttgcatttattattataatccatatcttctataatatataatacatcttttggctcaatatttttgaatatatatttttttaatataaattttataatactattattaggaataatatctttctttttataacaattataaattattttatcaataatagtttcatctatttttatatctatcttcatttattaaaaatttattttatttggatattagttatggaattaaatgaataatttattaagaggatctgtaataacaactgtaagacataacacatatgaatattatttatgtccatctatggcaacacacggatgtatatattttggaaaaggtttgaaaacatatttagaaagtataaaattatatttgtcagatattaatgatactgatgaatatgttataaactgtaatggaagatatacataccccgaagactattacaaatttttaaaaaaaagagacgaatataaaatatataatttttgtaaattggataataatataatcccatatattaatattatggattatgctgcaaagtattcttgtaaatttataggtaaaaaattttcatttagacaaagaggtaattattgttttgaaataatcgtaaaatcatatattgcatctataaaaagaatgaatcacacattatataaatttaatatgattgatatatatgtatataaattttataatagtagaagtataacaaattatattaatttttatttagtttataaaaaatataaaaataaaactaaacaatataacaatagtaattgcaattttattattaaaaaaataaataatatattatatataaattcaataacaaataatgaaaaaatatgcataaattagatatgcataaaatatgttaatattaagaaacatcgattataaaaatatatttatgttcagtaaaaaaaattatacaaattggactatttttcacaatttagatatagataacaacgagtataatataaatgatatatataatacatttgttaaatatgtacataaaattataaaaaaaaaaatattaaatataaaaaatcaaccagcatcagatgaagaaaaagaaaattttcttaatgtattatcacttaatcctcctgtaacttttgattcaataaataatattttaatttttaacgaaagattagaattatcagaaatatattatttatttacatattttaatccttttgtcgaatattgaaaaaataaaaaataaataaatggtttatttactagaatatcagggaatatttatgacccattattattatttatatgatactggaaaaataaatgctaaacaattagcagaaatttgtaaaaaaactaaatcaactatgataatattaaaagtaataactacaataagaaattcaacaatacaaaataaaataaaacctatggatatgatatcaccagtctaactatttttaacatatgcattatatttagcatcatacatattatttaacgatctacataatttattattattaaaacttggatctaataatacttttacatctatatttgaaaataataaaaacacgaataatggataatttttattattttttatagtatttaatattgatatggtattactaaatttttctattaatgatatttgagtttgaaatttacgttcacacaaaaatctatataattttttatatttacaaactttaaaggatctaagcaaaacatcattattattatcaatgttaaaattatattcaaatggaaaatttgatagatcttcgttgtgttctatgttagtatttgaaactaatttttccaataatactggattaaatgctaatctagaatataaaaatttatatttttttttatctaaaatataatcataacatttatttattacttccatttttatattattaatcgtatatatattatcagaatctctcaacgaagcatgtaaaataccatatattttattttctgtaatatcgttattaggattttcaattttaatacaacatattaaaatactcgttaatgcttcaatataaaacctcattaatcctctaactaacaatctgtgtatattatcttttgttattttaattttattagttctaacgtgatttaaaaattttatatctataccttgatcagacatatcgtcaattatatctatgttttgaattatattaggtaattccaacaattgattaatattaaaatatgtatcggtgtaatgtttaccataatctaatcttatttcttctattacaatagaatgtaaattgtttcttaattcttgatcattaaacgcaaatatattatcaattatatttcgatcaaataatatataattatttaaattatttattgattcattaacattattatatatatatgatatattttgatcagatataatattatcttttatataaatattataatctaatatatttatatttatattcaaaaaatgtcttacattatttatataatcttcgatatttgtgttattagttaataaataatccaaacaagatgtattaattttattaggattgttaaataatatatcaaaattattattatcagaattacaatatctttttttatgtttatatattatataattaaatattggaaatgatctataaaaaaatatattattaattatttcaaatttattattaggagcatttaaataatttattaaaatattatcaaattcagatatcattttattttcatgacctatatttaaatcatacgatgttatattttgtatttttgtatcataaatatatttatatatcataaatatagtttcgactgatacactattagatatcatattgctattatatataatttcattgatttccatagccattaaagcattatacccacctctatattttagaatattaaaattagtattatcgaataataaattcatatttaatgaatttacttcaggtattcttgatatatatacattaataaatttgtgagaaaaaatatctgtatattttatattttcatttgaatatattttatgaatatttatattttttgatatagtgttgatattgtataattgtgacgtatcgactaaaaaaatatttatatcatttttttttattcttttattggattggatctgtgatgtatatgacatttataatattatattttataatattattatatcattgtcttaatccatacgcaacccacacacaacgcaataattgagaatactattattattattataacgactaatattaaaattttaagcggagaatctaatatatttgataaataatctaaaatactttttggtgttggtggtatatattcatgaattatttcatttttcgatataatatcagaatatatttcatctgtagattcgaaagatttaatgtcttgtaaatttggtaaatttttaatcttttcaatttgaggtataatatcattatatattggcatttgtaattctatttttttattatttaatactgtttctatttttttacctgatcttctcatagtattattgtaaacatcatataatatattatttaattcaatattatatttatccgggcaataattggttatatgtgattcagaaagtatttcaccagtttgtatattaaaaaatccattatatatattattattaattttatacataattggaatatctgaataacaactattattattataactatttttttcattgaatttaaacttataatcttcgattatgttacattgttttactttatatatatcatattctttgaaaactttaatattattaataccaaataatgcaactaaacatctatatggattcgtgttacacaaagcgtctattattttattatacattttaatatttttacatataatatatgtattatcaattaaattttttatttttaaattataataatttatttctccgctatatacactatttggtaagatattatcatcaaaaatattaatatatacattttctgatccaaataaatttttatataattcttttttgtctgattctaattctattaaatttgttatatttttatatttaattgtgaattcatctttatcatcatcaataactaacttgcgtttatttataaatacttttaaccaaatttctctaatttttgttaaatttgttataccacatctataatcataattataattatttatagttccaataaaatatttattttcacaaataatactatcagttatgggatatgttatataatatttgcaatctgataaacatgtcattatattatcgttagtattaacaataatattatcaaaaccaatattcatagatggtatttctataatattttttactaattttattgtaacagttttttctatcaatttgtatggaaaaataccatttttataatttacaatgttaggtaaaacagatgaatcaaatattttatataattcaaaacttatattttgaatattccataaatacatatattgtatatgtaaattattaactacatcagtatatttacatttacctttattaatatttgtgtctacagcattactaaaacatttttctattattttattagctatcaaatcatctgatttatcattgattaatataatactgcgatcagagtagaatctatgtttgaattttttaatttcagcatatcttccagtgtcagtagaatattctttatcataacattcattatatagccatctattagaatgtctattattgtaatttaatccatttaacatattataagtaggattggttgggtattcaaaagttttttcatttttataaccttttattttattattagtatgtaatatattaaatttaaaatcattactatagtcagtcaaacatattctttcaatacttctatataacattgaatctaattcaacataattttctttccaaatagatgcattaatagttgtatatttagtattatttttattacattcagacaatgatggtattttaacatctgtaaaatttgaattaacatcacatacaaaaggtatagtaccaaatgatattgttacttttattattaaaaataaaataattaatccaaataaagctcccatgttaaaaataataaagtcacagttaatatattaaaattaatatattttttcattatagtattttataaaaaaaaatataataaataaatgtttaaaacagatttaactaatgaagaagtatcagaagctgctaataaattaataaaaaataatacttgtaatttctatgaattaaaattagaaaatattttagacaatattgatttaacaaataattgtatatattgtaatgatgtaattaaagataaaattattatagatacaaacaatataaaagtgggatatttttgtacaataacatgcaaacacatatattattcaataataagaacaattttcaatttacccattcataaaattattaattttataccattttttttattatccgaagaatctaaaattaaatataaaaatataaaaaatattattaattattataattatgatgatatatctatttttagtaaatataaagataataataatatatatactgaatttaaattattaattaataataaatttatttatctccaagaatcgtttgaatatatatcaaaaagtaataattgtatatattgttattctactaatataaatgataaaataatattagagcataataatggaattattaaaggtttttgttctatagtttgtagagattcgatatctaaacaaatatataatacaattatgcctatttataaatttagtgcatatttggtaccatttgaattaataaaaaataaaaaagaatttttaaataatattaatcatataaaaaatattgataatttatatggtggttattgtcatttaactaataataaaactaaagtagaattatttattacaaattaattattttctctttcaattcttttaattatatgtattaagtaatcactatttaatgacggatctaaaattattaaattattaataatttttataggaggattttctgttaaatattgtattcttcgttctttttcttctctaggtaatgatatatcattttttatttcattgatttttctcttaattatactacgaacttttattcttagttgtgccattaaatcatcaccaccaaagtttgtaatttctaatatttcaacccactcacaacggttttctatataatcatttcttctaattaatttaaactcttgtctattatttctattttgtaataatatataataattacaatgatctggtgatggtggtctaggaggtcttggacaaggatcaattggaatgtttaataaaagtttgtctaatttcatatttaaaattctaaattgatcacgcatatcattattattattattaattatatcaatcaatctattaattttattaattaaatctttattatctataacattatcagctattaaattatatatttctgtaattcttctattcatagattcattagcatctattaatctatctaatttatcattaattgatttattatctaattttagcgaatttatattactaacgatatctgctatttgcgttgatatatttttgatattattattaatagtatcataatcatcttttaaattatttataatatcttctaaatcatttaatttgttaattatagaagtattatctatattttcaagaatattatccaataattctttaatcgcgttataatctttttttaattcaataattgcattgttaattgcattattaataatattgataatattattattaatattattaatactattagtaagatcagttaatttatcttcaatattatctaaattatcagttataactgtagtttgatttgttaattcagttaaaatagaatctgtttgtgtttttagagtttctattaactcttttatttctgttaaatcgggtataggtaacgacattatttatgtaatatataataaataatattgtttgttcaatttaaaataataaattatattattattttaaatactgtaataaatttaatactatgaaataatattaaaaaatattaataatgttgataagtaggttaaagtgtaaatgtgggtgtaataattactttaatatagatatagattttatagattacgaagatagaaaaaatatatatttgtcatataatttattttattttaataattattatatattaaaatcatcatacttagttatatattataataaaaaatgtataaattttacaaaatattttaaaatatatgatcacgcaaataataaactgatttcttttaaatggaataatataaaatggataaaattaaaaataaaatataataaaaatatttatataaaatattttgatgtatataaaaaacaagaattaatatgtttatgtgatgactgtaattataattttaaaataaaatattatataaatattatagataataatgaattttatagactgttttttactcttcttgtagaatataaatataaaatatgtaataattttacaaaatattttaaaaaaattcaaaataataatttaataaatttatatattgataaagttatatggaaaccaaacatttattatattcattgtggttcataactatttaacataatatctatattttttattatatttttatcattaataatttgatctaaatttgataatatatcttttatatatttttcaacacatattctataattatttttattttttagatagtcttctaatattataacatgtttagaaatatctatagtatattttatattccacttttttatatcttttgaccattcatttattttatgagcatatataaaatcaaatctttgaccttttgttattttatcattaggattttttaaattatattctttaacacataattctattggataattaggatctttataaacaccactatattttacagattttttaaaatcattaatatctaaattttgtatattctctatgatatttttaaatgcagatgataaataatcatttattttaacattaatatttataccggtattatcatttgttaaaaaatcttttaatatatttatagtattttttaaaatagttttatgtattacagtacaatctctacgtattaacgcagtacctttagtatcatccattaattgcaaaggatccatgttaattacaacttctccaatatattttttttttgctaataatatcatccaataatacatcttctcatattcaaattcaaaattatctgttaatattttatttttcttatcatttataacattacctaaaaatgtaaaacatttatgacctactttaactttttcttctttactattaaatttactttcaaaattaacagttataaataaagaatctgtgtctccatattttacattaaatgtgaaattaacatttaaattaccgggataattagtttttatgggctcatttgtaaaaggattattgcatttattaagtattaaaacattatctatatattttgaattatttactaatgtttgaatatatttaatacaattttgtccttgtactgtacaatattctgcgcaatatggcgaattaaatataaatctttctgaaccagataaaccgtacatactattaatcgttatttttttactatacaaagctgaagaatagaagttatgtaaatctacattatctttatttttatttttaagatctttatacatgtttttcatttctctgccatcttttaccatttgagtagtaacgcccaattctcttctatccattagtataaatttatacattttatctttaataattttaatataacaataatcaggatatttataattatcttttagatatttttctactttatttgccgcttcttcgtcatcaaataactttattacttttactactttttctggacttaaatttgcttctatgattattgatggatattcggaattaaaatcaaacactgctgttaaactatcaatatatttttgttttggttcaataacataaccaccttcgaatttttcaaattctacattacctggatatatcattgttttatttgaatataatgtttttaataataaacctgatatattattggaacttttgtatttaaatgccatacactgtggtaataaatattcattgctaaatgctattattttatcatgtatcatatcgtatttaaaaatacaattacataatacagtatcgtgagtacaataataggctatattatctgatttttctttagtaaaattaacatatgcatttttatctccaatatcaacatcatctttagataacataactgttgcataattatcattaataggaatatcattttcatatatggtaaattttttattatgcgaattttttatcgatgttaaatcatataatttttctatatcatcaataatttctgtcttattttttattttatatggattattattaataaaacaataattagcagttcttataacatcataaaatatagatattttgtttttattagcttttgtattcaatggttcgataatatattcattattattatatgatatcttacaaaatatattaaatctttctttagttatttctgataacttataactatttgacgaaggatatgtttttttaatataattatataaatctaaaaatataattccgttagtgctgtcaatttcatatgtagtatcttgattataagaaaattttgatatttttatctcatttgtagaatatacattatctaaacataaaccttttaacttatttattttcctcct

SEQ ID NO: 24 - DNA, 50000 bp, Amsacta moorei entomopoxvirus
atcttgaatatatgtaaaatcaaaattatgtccgttgtatgtcaaaacataatcgaaatcctgcctaagagtatacaatacaaaatgtagcatatatttttctgtacaatatattgtaatatatactttatttgtatttaataacttattaacttcggtatatataaatttatctttcttttctcccacataattttttattatttcatagtttattaatgttattattttctttatcggatttgtattcttatccatataccaatctatacaaatgtgagaaataggaaatttattagctgttggaaattcaccaaaatgttggcattctatatcaatagaaacgcgacttgcaggaatatgtttatctattttaacataattagaaaataacaatttaggatttttgcaataatatgatgttttatttttattatatgttttaattttttgcatattatccatatttattctatatgatccagatggttctatattatttaatacataaaaccacctatattgattaatgaatatattatatttgctatatattttctctattttataaggagtcataaataaaactaaatcattattatttaatgttattttactatcttcagtataattataataatattgtatattaacttcatttgttattattttataatcttcaagaactaaataagaactattgaatgaatttttatatttatctatgttattttttatattttttaattttgtatttgattctgataattcgtaatcacaaagaaaatattcatatatatcaaataatatatatattatttcttcggtatcataatctttgcatttacatactataaattgttctaacgatgatggttttattatataccaattataaattttaatatttatttctttactttctagtttatcatacggtattaatatatcatcattatcacatggtttatttaatattctttttagatatctaatagcattataatcacttcctttttctttattttgtaactgtgttatatcaaattttaatataccagttcctaaaaaaggcatcttaaatataataattttttttaataatattatttcaaaaaaaaaaaaatttaatatatatttttactatttaaacgttcttcgtatgtttcatcaataaaatttataaaagattctaataattcttttattgtatttctcataatagtatttaatgaatattctgcgtcattaatctcttcatctgatggttttaaatatgttccatttattccaggtatatcatttatagaacacaatgcatccattttattcttttctataatatcatctacgttaatatatttataattcattttatgatctaatatattagaataacttattttattactataatcaacattattttttttaattttaatattttcaaatatatctgctattttattaaatatatcaataaagaatttttttatattttctttaggaatatcatcataatgattatatcttatatctatagtataaatatctttttcttcatgatatttgctatacatagaaaatggttttttatataataaatttttttcataataatgtttagaattttctatttcattttttatatcaactttcacaggataatctttaaatgttaataaaatatttttatgcaaattgatattttcttcaatttttgaattacatgaaaataataaaacgtgtgatgaacctatagcatcatctgttttacgttctttagataaatttattatatgatgtttatcagaatgtttaggattatcaataatttttattttaccagtttcgtcatcaaatataaataattttatatctttataagttaaaaaatgtttgctaccatcgtcaataatcggtaagtatataccacaattatttatttcatctaaattattattaaataaatatattatatcaacatacgccagcatattagctatatttagatatataggtcctaaattatgtttggtgtctattattgctttagttaaagttggtattttaatttctttatcaaaaatattaataatacaattgcatattggatatatttttttttttttaatatcagtaaaattatatgaaaatatcttatgttcgaaaaccatttttattttataatatttatattttttcaatattgttattattgataaggattaatgattatttaacaaattaaataattatattatagcttatcaataaataattacttatatcaataaatgaaaaaaaaatataataatacatacaagattatagaagaaaaaatttataatacggatggacaagaaatagtagacgataatttattaaatattataaagaaatataaacctcccaaacatcttaataatatagaattaatagctaaaaatatcgaggaagctgacaacggtataatatatattggtattgatagtaaaaataaaaaacaatatatttacggaataaattacgtaaaaaaaagaagaaatgacagaataaaaatatttttaaaagtagaaaataaaatacctaaaatagaaaaatatattaataaagaattgaatatattcaaaaaaaatggtagtaattcatcacacatatacataactgataaaatgatttttgctattatattattagtagaaatgtgtttttttataagaactggaaaaaaaaaatatttagaagataatgaaactatcggattattgacattacaaaaaaataattttacaatagaaaatgatgttatatatataaattttaaaggaaaattatctcaaaatcaaaattttagcatattaaaagatgagcatttattaatatacaatatgattaaaatattatataataagactaatgattttatatttaaaaatagtgatgatataatatttaatgaatctaaattatattctatgattaaacaatttaatataaagttaaaagatataagaacatttggagttaatagagttttaatacaagaattgtggaaaaatgttagagatttagatattatggatattaggcataaagatataaaaaaaataatatcagaagtagttaaaagaacagctaatataattggtcatacaccaactatatccaaaaatagttatatagtagatgaaataagatctataatagataaagatactataaacaaagctaaagaaatgacatttgatgaatattataaatatattgtagataaattaaaagaattaaccaattaatcagaatcttcttctaattcattagaattgattttattagaatgagttatttcttcatccgaagattcaacatcatctttttttttcttaatttctattctagaattttttttattattctttttcttagcatctttaagtttagattctgtgatcgattcatctatattatcccaatttttatttgcacctaaagtgtttaaatttaatttttctttcggtttatctaacgaaacttttttattttttgatttatcacgtctatctccgaatttaataacactttgaccagcttcatttttatctataactggaaaaataattttaggatcattaaaattatttttacacttaaatttaattttatcaattttttcagattttaaaatatctttattatcattataaaggtacatatacataattaaatcatttaatgttctgaaatatttatctaacaatggtccaattacaagtttaattttatcacacacaatagatgtaatatattcagatgatttgaagggtagaataaaactaatatcgttatatttataatagaaactatcatcaatattacagttaaaatcacaatttaagttagatatttctttaacgaaaacattatcattgaataatttatttgtatatgtcataatattattactataattaactaaaatatcattattaatattaatatcatataatttaattctagttataactaaaaatgtattatttaacatattaattgtattgtcatatttattaataatctcttttaaattatctgacatatcagaaaataataactcacaactgaataaatcattattaattacattattatatatttctagtgttttttcattattaagtttaacagagacttttttggtattaacgttttgatttgcacgttcagatgccattttatattcttttattattatatattttttttcagtttttttaacaaaaatataaaattataaatggatcagatagaaataattaaaactattaatagtatgatagaatatataaaaaataccaaagataagttatctatagataattttatattcgaacataaagatttatatgataatgtagttatttattcaaaatatttatcagataaagattttaaatttttatacgttattgtagaaaaatatccagacgcaaatccaaatataatatataatatatttaaaacatcacagatatctataacgcaagatattaatataaataaaataatacagaataaagataatacaaaaataaaccaagatatacacacatataattatttgttattattaaataaattatatatatttcaaccaataccaaaatttataaatatattatgggatataaaatcaaaaaatgtagataatctagacaaaataaataatataaatacaaattcgttaaatataattacaaatatagaaatgtcaaaagttaatattatttatatatcatttacatatatttcatcttatatagaatcacataaaagtgaacttacgttaaataaaaaattttctatttatgataatttaagaagaataattggcgttcctatatctaataataactataaattaaattattatattaaagctaaaatagattcagaaacattaatatataatatatttaattctgtagcttttaaaaaagtaataatatatggatttggagtttatcaaataaaagatgtaaaaaatataataaaagatacgattaatgatgtttcgtcatacatagttaataataataaagaaaaattgtatcaacgtacatactgttgttgttattttttaaactgttattatgaaaaaatttttaaaaatttatccacacaaacatatgataaaatattatattcaaatgtagttaatattaatgatgttattcataaaaaatatgaatatttcgaatgtcaacatgtacaagaatataaaaatgtttttaaaaatgtagaaaatttttatattaatactaataaatttctagaaaattatattaatattgttaataaagtagctatatgtaaaatttgtggagaatcgttagatatgtttaattttgaagaagcaaattatattcaatctaaaggcgaaattataataacaacaaataaagaaaatattttccaatatgaaacttattcaagattagttaatgctgaattatttttaacagatattataggaatttatgatgatatttttaacacaaacagaatggacgattttaataatatatctagaataattattgatttttttattgatattaacacaaatagattagaatatcaagataaatataaaaaacaaatctctaactccaaattattttttataagattgtcaaataatttatttatagcagtttataatgaaaaagaacaatatgccgaagaaagacaactaaacatgtttataatattcggaatatctttattattattaagtaattttaatgaattaataggtataataaaaaataataaaaaattaaaaactatatttgataatcaaaatgatattaaaataaatttagataattttataaaagatactgtattcatatatataagtaggaatagattaatagataaaaaaagtagagaattgattaattatgatactataattgatgtttatttaaatatattaactcccgaattaaaatcgtgttataatataatattaaatagattatataaaaatatagatattttaaaatatgattatatagaattaccagatattccattactacccgtaacattaggatataaacacaaaaatattgatactggtcctacaatatcttttttaccactcgaagatgtaattaattataataatgtaaatatttatgaaagtaatattagatatattacatacgatacgttaaaaattaaaaatttatctgattttgatattaaagatataaatgttgaattaaaaactataattgaaagatttaattctgaatattactatagaaatattagtatattaaactttgaacagatggataattataatttttatatagatataggacaaaaatattttttttatataaatgatgtattatcgaatagtaatattgtaataaaaagtaatatttattctaaaataatgaattttggtgattctttgccatttttaaataaaatatataaatttcattatacattattatttgataatctgaatttattaataaattttttatatccgaatgttaaaattatatttaattatgatcaagattatataactagagattattttcattatattgtttataatatattaatttcattaattaatactaatatattatcatggatagatgtaaacaaagatataatatctaaattatatgataatactttaagattttatgttaaaaatatatattaaaaaaatactatatatcatattgttcattttcaatagattttataatatttatgaatttatattcttcacaacgatttaaagtaataaaatttatattacatattctttaaaaacaatagcattatttaaattgaaattcattattaaagtatataatccagaatcatttatgtatataatctttgaattatttccatttaacgtgggagacaaattgtctcccaccttatataatatttctctatatgattttttataagattctttcaatctttgtaatatttttttaaaactagatttttcatattctaaaatatttaaaacatctttgccacaaaaccacggattgtttaatgtgcctatgacatctatagatttattattaaatttaaatatttcattaaatgtttcaataaattttatatctaattcatcgtttaaattataatctaaattagaagatgtgtaattgttgataagtatattttccatgtttttataaaaattaatatattatttcaattatatatcatattgttcattttcaatagattttataatatttatgaatttatattcttcacaacgatttaaagtaaacttatttccattaatttctataaaaggttttctatttcctaatctatcttttaaaatacttttatcttttattatatctttaagattgttaattcttattttatctaattcatatattttagactttaatctagaacacatatcaataggattaggattatatttttcatctataattacgttatgtttttctagccaattagatttattagtttttatatattgatcttgagctcttataaatttatattcattattaataattttattttttaataaaagatatttatgttgtaatttaacctctttaggttttacattcctatcttctattacaacatttaatttatctttaacatcttttatttcttctttagtttctataagatttattcctaattcttgtaatttatttaaagctaattgattttgtgttaataattcgttattttgtttagatatattgttaatctctaatgattgattatctatttttttaaacaaatcatctattttatctttttggttactaataatatccatatattttttttgagctcttttacgaatagaaggtaataaatcaaataatatataattttgaaatcctttagcagaatctttagtacaatgtaatataatataatataaaccagcttcattaacatatattgctttattatcattatttttcgtggggggcaaattgccctccacagatattatatcattataactctttttaaagctagtatttaatctttttaatacacattttgcactttgatctgtatattctaatccatctattaatatatctttccctttaaaccaaggattatctaaactacctattatgtttatagatatattattaaatttaaatatattattaaaattattaataaaattatctgttaaactatctattgaaatataattaagatcgacatatttatcggatttaataattatattttccattttatataaatatataatatttcattttttaataagtaaccatatttataaaaaaatatttataataataaattaattattttataattttataatttatgaaaaataaaatatattttattaaaaataattaatataaattaatatgactttagttaaacataatacgatgcataattttttacattcaaaatcaaatatatctgaattagattatagtattgaatcttcgtcagaaagaagagatataattataaaaaaatacgatacattaaatataaaaaattataatagaaaaacaagttttaatgctatattaataacaagcgataataaaattattattgcagaaagaaaatttagctattatatggacacaatatatataatatctacatataaaaatatatctgatgatatattagaaacatttattaaattatttgataaattaactaataaagaaaaatataatatatataataaaaaaagaataaataaaaaatatatttcaattataaattttattgaagtatatttcgatggtaatataaatcataaatatttacaatatttatataatgtaaaatctagaattatattaaataataattttagatacagagataaatttttaattttacctggtggtaaaaaaaataataatgaaaatattaatgaagttataagtcgagaatcacacgaagaaataaatattcctataaataatcaagataataataatattgatataatgcaagactattattcagaaactataatatttgataaaatactttcaaaaaaatttattgatgttactattatagcaaaaatcaaatatagttctattcaaatattaaatttctttaaacccaatcatgaaattagtaatattaaatttatacctattaataaaataaattcgatgattgatatattttattatgtacaaaaacaattaatctattgttaaatattaaataacataaataatatttttatataaaatggttaaatatattaaattaaataaaaaaatatttaattatataaaatcaagattaaaatcacaagaaatattaatatatgataaaaattctaatcatgctataattacaaatgatatgatagaaaatattgatttagatataatatgtccgttgattttgtataacgaaaatgataaaattattgacaaaattaataatatggataaatttattgagtgtaaatatcaattaagggaagatcaattagagttaattaataatataatgaatattaataataattattcttgtaattcacccatatatttatcattagtatgtccttgtggatatggtaaaactatattgggtatagatataatatctagattaaaatacaaatgtgctataattgtacctagaatttttattatatatcaatggttagataaaataaaacaaaaaaataatatatttgcatctacgtgtggtagaaaaaaagcgattgaacaaataaaaaatggtttagagtgtgatgtgtttatatgtcctgataaacatttagaaaatgatattattagaaattatatatataatacgtgtagtttagtaattgttgatgaagctcatcgatataatgctaataaaaatatagtaatgactagatttttatataataaaatatttaaattttgtttgtttttaactgctacgccatctaataatatgaatacttttataaatgaatttattgatattaataatcaatcacagattaaaatattaaatgatattaaaaaaaaattaattatatttaatttgaaagataaaatatttactccaattaataataattgtaaatattatgttaataaaataacaaataataaattcaataatatatatataaaaaattttaattacaaatattgtatttctcttgatgataaaagaaatgaaattattatagatttaatattaaaaacaactacggataatacaaaatgtttaattttgacagattatagattacacatgatgaatatatataatttattaaaaaaaacacacttacaaaatataatttatatatatgatgtaaaaaataaaaaatgtaatgatttgttaacagaaattaaaaataagaatgaaaaatttattattatatcaactatatctgcttgttctgaatcattagatattaataatttaaatacttttcatgttttattacctattactaattctaaaacaataaaacaatgcataggtagaattatgagaaatatgaacgaagataaatatacttatatatataatttttctaacatcaataacatgattaatatgtatattaatgataaaactgatttaataagaaaagtattgtctgattgggaatgtgtagaaataaaatgttcatattaaaggtgaatttttatcaaaataataataaataaataatgaattttatgccacaatattactatataagtgatattaataatgaaattgaatatgacgaaaattttaatcctggtaaaaaatttgattttaaaagacaaggtcaaattaaattattaatgaatgaaataagatttttaacagaagatgtagaattacataaaaattacaaaaatgaaaatattaatattttatatattggttctggtaaaggatatcatatacctttattaattaatatgtattctgattataaaatacaatgggatctatacgatccatgtggtcattgtgaaaaattatataatatccaaaaaaataataataatataaaaatttatgatacatattttaataaatcggatgtagaaaaatatgaaaatatcgataatttactatttataactgacataaggactgtagataaccccgacgacgaaccaaatactaaaaatttaataaatgattatgaattacaaaattatatattaaaagaattaaaacctatatcattagtaaaacaacgcgatccttttcctaatgattgggatgattcttataaattatcaatacctgatggtaaggaatatatacaatgttttcaaaaatataattcagcagaatatagaatatttatatctggaattacaacttttgtagatatcaattctgttatattaaataaaagaggaattgatagaaaattagcttggtataatatgaaatatagatttcaaaatgataatgattataaaattgcatatagaatattaaataaatatataaaatcagaaaacaaaccaatattaaaaaaatataataatattaataaaaataatataaaaaatgtcattagatcattatctaaagaaatgggttattattaatttataacattatttagtagtatttatatacttatcaaaatattctgaaaaattaaaattagttggttttatattttgattaataaaatccactaattttgttactaatatttttctataagatgggtgtatttctaaaggttctgatgtatcttctatttttatagattttatattatttgaattattttgatcaacttcggtagtaatataatatatatctactggcgtcaaacgtttaacattaaccgacattacatatgtatctttttgtttatagacatagcaaacatcttcgggtatttcatatttttctactttttcatttgggttttcgatagatatattaattttatcatttaaattataagtaactaaaataggataagatgtatcagaaaatattaatctattaggatttcttattttatattttgtatcaccactcagaaccataattctattattttgtgacgaattattaatattattcataaaatcatttatcgagaattttgaattttcactaatataatctcgcaaatcatatatattatagactaagtaattatttttttttttagtaggtgatgtatatggtatagtgttatattgactattagtttttaaaaaaacaccttttcctccaattattttaaaaatagttttattatctggaatatttgtagctccagctataaaattatctatgtatctaactctaccagcgtatgaattatcaaaatcagatataaatgctattgggttacaatacatttatttaataaacaattttgaataataataataattaataaataatcatggacgaatgtactgtaaatgaacttaaaaaaatttataattttattgatgtaaacaaatttttaaacttaaaagtagaaaatataaatttatttaaagatgttaatttagataatactgattctgatgaaataggattatctatacttaacataaatgataaaaaaaaaacattagtagaaagattacatatcccagataaatataatgactatattaaattagataatttgtttaataatcaaaaattatctggcgatattaaattaaaagataatattttaattgaattagaaaaacaaaaaaataattttgtatatgaagaagataaatataatggtcctaatcttattgttgattgttttccagaattttgcaaaatatgtaataataaaatcaaaataaatacaaattttaataatgataatgttgaaatgcaaataatatgtaaaaaatatcctgatcatatatttaaatatgaggattattgttaatttaatattttttattattttttgaaaaataactattaaatatatttaattaatataaaatgggtcataataattccaaagaaaaacaagtcataatatttaacaattatttatttgaaaattcagattattttgaacgtcataaattatatagtctttataagaatttattagctgtgaatgaaatagaaaaattattttgtgataaactaggatataatataaatatttgtgaaaattatacacatagtgatattatagataaaatatcaaatttattaaattattttgaaactaacaaaccttcgattataataatatttgtattaacatatcataccaataattttattcatgctgcagataaatcatatccattacaagacattattagaacatttacattaaataaaaatttagaaaatattccaaaagtatattttatacaaacagaaaaatctggttatgatttatgttgtaataataataatgtaatagatatccaaggctctgaaacactaattttacgatcaataaataataattctataattaatgaattttgtttaaaatataaatacaataaaaacttattaaataattgcattgaaatgcaatcaattccaccttcacatattatgatatctacattaacaaaaatgaattataatttatgatttttataaaaaaaaatttctatttaataaatatttttctggatctataaaatgataacaatgatatccaaacatatcaaatgccatatcactataatctgttacataattattattatttattataatatctttctgagataacgaataatgagtactaacatcagttataattattatttgatctttttttacatccatattccattttaaataatttttaaaattaatgcaattatttaaattatttagtgtaatatttgaaaataatattgcagaatcaaacgaagaatacatattaaattcgcaatttgatatatctttattaaacttgacatatatacttttattaaataatttttcttcgattataatattattatcctgttttatactaaaatatatattagtatcatttttattataatacgactcattatcaaacattatatcttcaattatatctattattttaaatttattataaaagtgatgcacattatcaaattttgattcatggtagtagctatccattttttataaaaatatattttcattttttattaattattgaataaaaataagataaaataaatgaataataatccgattgaagaagatattgcaaatttatttttgcaatgcgatcctagattggatataaaatctaaagttttgattaatgtagaattaccatttaaaaatttaaattatgatttgcctacgttatttaatagagaagaagttatatatacaaagataagtaaatcaggacatgaagatgtcataatgaaaataacatacgaaggtaaagaagataataaaaaaagttatttatattccagtttagataataaaggattttatacatatatctctatttctatttctatatatagaaaaataacatcattaaataataaaatagaatataaaataatatctaataaaacatattcgcatacagaaataagaatacctcagtatatagctcacggtggaaatacatcagaaaatgataattctataacacaatcaaataatcctggtggattttttaatgtttcaaaaagtttaaaaaaaatggtaactactagaatagaacaaacatatatttatccaaaacgtaaaaaaactcaaaaagcatatacttatcatctggcattcattagtaaaaaaccatcatttatgatgataaatgaaaaattaaacccgccacagtttttaactttagatatagattttaatccagataaaataaaatgtgtaatagattctaaaaaaacattcttacaaattgatatcatagcattaataatagcattatctaatgataacattgatgttgtttataaaaaaataagttctggttttagtgatgatatatctgattcaatcaaaatattaatagaaaatactaaaaatattttatctgaatataataatgatgccagacaatatgtcgacaaaataatcgaaattaattatattaaaaaatatccaaaaaatgaaataactttacaagattattttaataatattttcaatgattttcttcctcatataggccgaggaaaatataatgaaaaatgtatgtatatgattagtattttaagacaatcttttgtttctatatttcaatcagatgtttatccagataaagataatttagctactagaagaatttcaactgctgctgatatttttgagaatataataaggacttctattgataattctttcgaattagcaagagataaatataaaacatatattagtggatctggtaagaacaataatataaataatattttatctcaagttaaattattaccacaaataacacaagcgtttaataattttttcaatatgcaagatactaaaaatagtgatgttgtaaaaataggaacccactcaaattgggctgaatctatttatatttctaatgctgtagaaagaggtgttagtatagaattaacaaaatcactaactcaaagaaaattacacgcatcatcaattaatgtattagatatgatggatacacctgatcatggtacaaaaactggtcttgtaaaaagattatgtataagtacattaatatcacactatcctatacatattagaaaacaattatttgaagaagttagagaatttatagaaaacaaggttaaacatacattaaaagaagatattatttccggtgtatttatatcaattatagatgaatctgaacacgtaatagctcgtataaaaaattcagaaactgaatcttttataaaagatttaaaatatgcaaaaatatcaggattatttgttaaaaatgatataggtatagaaatattaaaatttcatgaattagataataacaaacaaatatatgtaccaacagatagatattttcaaataagaataaatgttggtaataaaagagcaacacaaccagtatttagagtagaaaatggcgaattagcatttaataaatatcctaatttacatgctgaattaaaagagagtaattcttacactgattttgtaactaaatattatgatattatagaagttattgacgtaggacaaatgatatattcaaatatgtgtaacacagttacagaatttaatagttacagtttagaacaaagaaaaaaatatgattatgttagattaccaaattatttatattttagttatttaacatcgactggttgtatgtatgatattggtaaaatgacgggtgttagaggtacatttggaacagcccaaagtaaacatattataacaggacctccagataatgtaatgaataaatatgatacatgtaactatttagcatatcctatagaaagaccatcaataactaatattcctatggaaatatctggtatagcaagaaatagtataggtacacatgttttagtgggattctttagttttaattacaacgtagaagatggcgttattgtaaataaagaatcgataaatagaggattattatctgtaatatcattaatgtctgtaaaaaatgaattatctgatacacaaataaacaataataatccaagtgcagaaaattctaataataattattctaaaatatcagcaacaggtttgccatcaataggaactgttttagtacaaggtgatgcgttatacagatgtttaaaaccaaaatttaaaaatgatgatgataatagatatatatttgatcaatctgaaacactatctaatacttatccagccgtggtagaaagaacaagaaaacaaggtacagatttaataaagattgatatgctattgtcatcatatagaagattgagtgtaggagataaaatagcaaaatctgtacaaaaagttactgtttcaaaaattatggaagaagaagatatgccttataatgaaaatggcgaaagacctgatataatatttaatagtcctagtattataagtagaaaaactcttcctttgtatgacgaagtttctttatgtaatatgttctcaaaaataccatataatgataaatgtgatgtagaatatattaattatcctatatatactgataaaagtcctttggataaatataattttatcaaaaaagaattaaaaaaaatatataataatgtaactgacgaagaattagaaaatattatatattgtcgacaaacattatatcacccatatacaaaaaaacctatgactataaaagaaggtgataaagaaactaaatcatttatgggacctatgttattctgtagattatcacaaatgtcggcagataaaatatcagtaagaaatagaggcagattagataaatacatgcaggctccgtctgggaaaaaaaaaggcggaggtattaaaatcggagaaatggaaagtgatgtttttgctacaaatggatctgtatatgcaatacatgaattacaatcagatcctgatgaattttatttaccagctcatatatgtggaaattgtggaatatttgctacttatgaagaaaatatagaagtaaaaagatggaaatgtctacagtgtgaaaatcttggtttgtcaccagaaataataaaaatgcgtttaacttatgctacaaaaatatttatcacacttttaaatgctagaggtatatctctaatccctgtaaaagataatcagtctatacgttatatttctgacgataatactattaatacttaacgatatacaatcacttaaaaacatgtttgataataatctatagaattttttaaaatagaatttatattaccgcaatacaaaacatctattttgtctttattatctaaattatccaataatattttatatgatatacatttaatatcatttagtttgataggaatgtgtacataataaaatataatatatgcacaagtgtctaatatattaaaatctatattaaaatatttattattatatttaaaacatatatctgggtaatctttatttttataattattactaccattaaaatttttatagttattataatttttatcaatactatacattatttttgatatgcaatttatcacataatcggttttatctatattactaagtatatcatcaactgttatattttcaacatcaatgtcaatattaatatcattattattaatttgtttttttaataattcaaatatattttttatacattttattttttcctttatatctttattatcaatgtcattgtcagaaatgtataataataaatttttaaatattaatattagtttgataatcatatttacaagtaatgtgtcttaatatagttataaattttcagaaaaaaaaaaataattatattaaacatagatcattttttcctataatataattttttactatagctattattcgttcacttttaaatatatgtcttcgtgataaggtttcgacatgattaaatgtagatttagttgttgaagttactatatatattttataattatcatcaaaataatcaactaatatcccataataatatttatcgttatttgatcttattttaactattgtgcctcttataggcctttcatttatttgttctaaatcttttattataattggaaatccactaggaatattattataatcaatgtatttattaaaagctaatataaaatattctataaaattgtattctgttttatttttaaattgttctaacacatcgcaaatataaatatattcagtttttgtattaattccatttaaagtatataattttgttaacggagataatattactaatgtagtaatgtcaaaattaaaatacaaatcttgtattttaaatacaattgttgcttttggtacattatacacatcataatgtaactttccgctataaaatatattatttctatataatgtgtatgaaataagtagcttttggaattttatttgatctaatctataagtatttgaaaatgtataatcatatacaggattaaaattaatttgatatatttttgattcaaataaaacatcaaaaacacatctattatttctattatttaaaatatatttatatattaacggaaaacccatagtttctctattttctgtcatttttgataatgtttcccaacaagaaaaagatgtcaaatcttcaataatatattcactaacatattttaaatttttacaaacaataggattatttaatatagaagtatataaaaaaaatatttttattctattttcattaaaattgtcaacattaacattacttaatatttgtctatcacaatctttgttaataaatatactttttaaataatcatttattgtagatagctctttaccaaatatattattagtcataaatgtagtattatcagacatttattactattatttttgaaataaaaaactttaaatattgatacattagaaagatgattaaaaattttattttactattttcaataattatattttcttataatattatgtataattatgaaaataataattttatcaaaaaaataatatatattaaagatattatttattttaataaaaatattaacaatatgtctgatatttccgaatggtattcgatttttaaaaaattaaaaattaactatgaaaataataatacattatatgattttattaataatatatataatgaaaaaacagtatcattattagataatatatataaaaatattgaaaatttcaaatattattataattataaaaaatgcaaatttacaaaaaatatttattggaattatataaattttaatcaaattaataatacagagtttctagaaatatgtaataaaagtttagaatcatggataaaacatatagattgtaaaaaatttatttttaataatgatagttattatgatttgcaaatatccgttataaatgatatgaatgtatttgataataataataatattatagcttattattataataaacatattaaaataaattataataatattaaaaaacatattaataataaaaagtttttgacattaatgttaattcatgaaataggacattttttaggattaacacatataaataattctcactcaataatgaatccatatttaactaataatatttattttaattatgatatagatgattcgtataaaatattacattattttgatattaatagattatgatgctagtattatcattggtataaatttactttgatcagaattaatattaaatatatatgaattacccctcacccgtattgttatagtatcatttaataaatcataagttattataccttgtcttttatatattacattttttgataaaaatacatatatttgtcttaatttattattattaaaattattattaactgctattattggatcatatatagtagtaaaactcattaattcatatatatttaaaggataatataataatactaaagatactataaaacatattgttataataatatttataatccacgaaaataacattatttatatataaatgtataaatattatttcggttatggagctaatcagaatattaattatttaataaaaagatataataattatgattttctaaattataaaataggtattattttgaatcattcttttaaattatgttattctaaagaaataaattcagtaatatctactatagttagtgataaaaataatatagtttatggtgtgttgtacgaagtttctgaaagtatgatgaaattatttgatagacaagaacatattgataaatatatatataaaagaataaaaatgcctgttttaatattagaagatgaaaaaataattgaagcatatgtatataaagctatatatgataatgataataatatggcttctaatttttatagatatagagatattatattagatgcagttaataatatattagattatccattgtggtataaaaaatatataaataatatatttaaagaatatttattataaaatatattaaattaactaatttaattagaaattttgaaaaatatattaatagttaactcacaatggataacttagtaaaatggcctactttttataataatccatatatattattaaattcgcaatatgtagctcaaagatataacgattctaaaaacaaaatatctaaagatgacataatgagatggattaatgattcaaataatattaaagcacattttgatatagaaatttatactgaacataatgaaacttttaaaatatataatactatagttaaattaacagatttacactctaaagattgtgatatataataaactgataaaaataacaataaacgtcccagattattgtatattacattttgttgtttatatcttcattgtaaaaatgttataaatttgaaataataaataacaaataaatacaaatacaaatatggatttaataaatatattaattaataaaaaatttatacctgatttatgctcattaataaatattgaaggaataatggaaatattaattgataaaaatataataattatagatgatattaacaatccttcgttatctgaattaaaaatttctataaaaacaatatatgatatttttgaatctatgtttggtaaaacgataattaaaaaaataatatttgaaggtttattaaaaaatgtattaaacgaaaccatagatcccaaagatgaattattaatgtatacgggttattgtaaagattgtgattcggacgctgaaatttttaatttagatatgaatgattacgaaaattcattatcttatgcaaataatttagtgatgaactttaaatataaaaattcttatacttatttagatttattttgtgataaatgtggtaagacgttgtacgacaaagatccatatgaaatttattaaataattgtattttattgaatatattctttaaaacaaatcttggtagtgttgatatagaagaaacgaaatattgaaaattaaatattggattataaaatcaaatttaatatagttatttatttaattatatgatagtgtaatttttatttatattttatattaatattattagaattatttttaataaaaccaggatcaatattgcagtacatacatttaatattttctaatgtagttggtaattttatagttgatatattactatctatattatatgatatgtctaatttttttaaattaattaaagtttctaaaaatttaaaatcttttattttagaccatgaacaattaatttcttcaattgtaataggcaatattatattagatataatactatttttattacctaaaatatttaatttttttaatttttttaaattatttaaaaaattaaaatcttttatattacaatacatacaatcaatttcttctaacataagtggtaattttatattagatatattattattttttaacacatgatatatctaatttttttaaattaattaaagtttctaaaaatttaaaatcttttatatcacaatttctgcaattaaattctgttatcgaagtgggaagatttgtaatcaaattaaaaacttaaaatattacgattaacaagattttttgaccagataagaaatgtagatactatatctaaatattataaaacaatagacatcattatgcaggtaaagattaaaatacttgttattacttaatttaatggataattatttattattaaattctctattatattcttctgtcataaataaataaatataaaagacaacaaagattacataaaagaaatcttatggaatatgtttttgatccttatccattcaatgatatttttatataatatataaacaacaaactttattatatatttaatttttgttattatattttaaaataaatatatataaatgaatatatcaaatataaataatgatatatatcttggtggtttgggaaatcatagcacagaagaaataaaaaattttctaattgataataatattaaatgtataataacaatatggaattttaataaattaaatataaaaaaattaaatattaatgttaaagattatatgtatatacacgcatatgatctaacaaatgaaataattattgattattttgatattactaacaaatttataattaataaaataaaagaaggtaagaaagtattaattcattgttatgctggtatatcaagatctgcaagtatagttattaattattttatgaataaatataatataaattatgacgaagctgaaaaaatagttagtaaaaaacgaaatataaaaccaaatatattttttatacttcaattaaaattttataattcatataaaaatataaatattatttatttaattatattatttgctattagatatacactaaaatgaatataatagatttgtttatatattttacaccaattataattatattattattatttataatatattatatattattatatgtttacttataataaccatttctaataaataatttttttggatattttgctaatccacctttttctgttttaatagatggcaatttattactaacagaataataatcattataggcagctctatatgtaccgtctatcaccaatatattattaggatttaacttattgcaatttttacatatgtctggtacataatataaattttcactcatttatattaaataaataattagtattattggctatttgtgtttttaatctatctatttgagctcttagattcattatatgttcatcttgatcctgtattaattgcaaatatatattacgttcattaactaaattattatattcgtcatttaacatattatatcttaatcttaattcttctaattgttctattaaagcattataatctcctatattaaaatcaaatatttgttctggtacaaatcttaaattagctaaatattcatcatcgaaattatttaatgaatttgttcctggtggtatatttattattttatagtatattataataataataactgtaattaatattatcgacatgaaaaataataacatttaatctctcataataatcagtggattttcagattttaaataatatattttatttttatcaaaatatacattttcgtctgtattaatatatttaaatttttgcggaccatcatatacatcattaataaatttaaatatatatataatacttcttttagattccaattttatttttacattcatttttacatatatattatatattttataaggtatatcaattatatttttatcatctgtgctcaataataatttctcagtttctgaaccatacaaatatataataaaatattctaacatattaatttcatatttattaaaaattctatatattttatttatacatttatctatatctattcctatagacttcatataattaacagttttatctactctattaatattatcaggaattacaaaataatctttttttatatctaaaccataatatttaaaaattattatgtaatcccataaatattgataatttatatttttaaaattagtatttaatttatctaatgtgtatgttcttatatatgttccttttgacactcttcctactctaccttttctttgtttatacatactatttgttatatatgttatatttccatctataaattcttttctatatacttttccattatctattactaatttagcattcgatatagttatagatgattctaaataatttgtacttattatgacatgaatatgttttttattattttctatataacgaataacttcattagcattatctgtttttccgtgtatagaataaaatttatatataggatcttttatactttcttctaatttttttttaataaaagttaattttggtattgattcataaaatattataacagaatatccaacaggtggtttattatctaataatattttatctatactatcaaccgtattttctatttctgtaacaggaaataatgtaaatccaggtatatatacttgtactattttattattaaaaaatcttaatatattatctatttcaaattctattgttgcagatattaatattatatttctgatatttataactttttttaaaaaatatgatactgctatacatatgtcagcatatctatcatgttcgtgtatttcatctataattataacactggaattttttaaattatttattgacaatctgttaacacacaataataaattagttggaaaaataattttattattataatattctttatataattttatatctttatattttattattatgggagtttctgttatttcagaataacctagtgattttatataattaatagcagtactatttattatagtttttctaggtaatgataataatgtatttttttcaattatatttatatcaaatataaaattatctatagatacattagaaattctactattaaacatattatatccatcaaaaagaagattataccaccatattattttaggtataatagatgtttttcctataccagttccaccagaaacaacacaatttaatctatttataaataaatcaaatatttttaattgtacatcaatttgtattgatctaaggttagattccttaaatttaaataatatatttttttctaattctatattattaatatatttaggaaacttttttttttgttcttcatttgtagataatattcctaatatattagaactttctacaattccaaatatttgattaatatctaaatttcctaatctatatggtaaatcatataatattgttgcatatgcgtatgcagaataagtaattgtagatccgtttgatctaatagttataatattattatttatatctattccatctattaaaaaatcattaattaattcaatactggtattatatatttctttattatctaaatatattttattactattttgattataacaaatatacatatttttccaatatagtttgtaaacagggtataataatattaaaaaattatatttatatttttttacataatcaaaatcaatatatgattgaaatatattagtattattaggaaataataaatgtgaaatatagttatatttattatgtaattcgggaaataaattatatgttttaaaatcataaatatttttaatttcttgcattataataatttatattaaaaactaattatatatattattgttgtatgaataaagtattattttttctttatttttatttaaaaatttaataatatcattaatttcatttttccatttattataattttgaattttatttagatcattttttaacatatatatattattttgtatattattaatactatttattaaatcacaattatccatatttaaatgacattaattaaacaaaaaaataataatgataaaattataaatttaaatcccacttttattatatgggattatgatataaaaataattataaaaaaatatagtatttatattattatttttttacaattactgtttattatatttatattatattattttttatatcaagaattaatttttatatataataatatatttggatatacattatcgcctgatgataaaaataattataatatatattataataaaattagaaatattttagactcaaaattatattgtgataataataataatttgagaataatatataataatacagacattccagcctattcattaaatggtgaagttataagtgattgtaataattttttgaaaaataataataatatgtaatatatatttattatattatacaaaatgtatatacaaataccagaatataaaaagtcatatatgtgtaaaagtttaataaactctggaacatacggaattgtatataaatatgcagatatttatacaaaaaataatgttgcgattaaattttttagaaataatgataattttacacacgaaataaatattttaaattatattaaaaaaaaaatatataataattctgatagtgatgaaataaacgaagttaaaaaaaatatctgttttccgatattttttacaaatgaaaataatgtttcaaaatatattatatttaattattatgattatgatttattatattacgcatctacatatatattacttaatcaagatatattaaatataagtttacaaatatgcaatggactgaaatatttacataaaaattctattgttcattgtgatttaaaaccagagaatatattatgtaaatataaaaatgatacattgcatcttgttataacagattttggattatcgtatatagaaaataatattattgattatgaaatcgtaacatttagttatagatctcctgaattaatatgtactattaataataaaaacaatataattgtaaagtcttctatagatatgtggtcttttggggtaattatatattttttaattaataaattttattttgatatttataatattgaaaaatatatagaatctaatcctataaaaaaattatgtaacattaactcgattgttgatagactgctacaatatgaaaaagatagatatacaagttatcaaatatataatgatctgaaaaaattattgaaataaatttttatattagttaaatatttttatatattattaaatggcagcatatataattttaaatatgaaaactatggtattaaataacgatggactatatgatatcataccttataaagcgtcattatccattttatataataaaaaaataatattcaatgatatattttttattaagtataatttatacgaatcaagagttgataagaaaaagtttaataatgcaatttcctttttaatgaataaaaatatatttccaaccaaagaacacaaaggaaagaaggttattagatataataataaaataggacacgatcctgatagttttaggaactttatcaaatctttaatatttattttaaaaaattatttaaacattacgccaatattagtttcttcacacaacacaaacacaatgtgggtgttaaataagctcaaaaataataaattagttacgacaataaattatattgatattcctacaattataattaataatattgatttaactaacgattgcgatataattaatgatttttgtattaactatatattaaatagtaaaatagaatataatatagaatctaccgatcacaataaagttttagatacaattttagaatatatttctattattgttaataataatttataatcgatgtaaattttattatatagaaattattattagtaacaatataaatatattaaggcaagagaaatgtgtcgataatatattatttatataaatctaatattgcttcaattatcttaatcagtattaattattaatatattgatatataaatttacatttttacaaattctttaatactaattaatacatttgataacaattattttttttaactaaaataaaattaactaatattatttagtaagcgtaattaaagtatatgcagtctacgaatttcaaattaagttatacatatcatttaatatacattaaactaaaataatacttttttttggactatcaaaagattgttttaaataaattagaaaattaatatattatcgacaataacatatattaatattattataattactgtccttaaattatatacagtattttataataatatatactatatacaatagttatataaaatattcaattattggacttgctatgacaattatataaataatataagctgccattaactacaattattgtcaaatattaactactaatatgtttttgtaaattataataatgattttattttgatatatgccattttaattaaagcttgatattttatataaagcgtcttctgttaagtgatattttatcaccataggtttaaattttatacccgtgtttttgatagattctatatcatattgatcgaaaaaattactattaggccgcaaagcttcaattaaagatccatctttttgtcttagtaatatttctgtatataaatttgaatattctatttttaaatcttttttagataaattttttgatattattatttcggaataaatcgtatcagtaaaaattaaatcagattttaattccatatttaatttattattattattatttcaattttgtttatcaaaaaagtcaggggtgtataataatttgacagtatctttatggtattttttagaccatttcttcagaatataaaataacggtagcgtaaattcattatttaaaattttatcgtcaaacgtagaatctgctattactatatttctattatctgatgttatattgacagtatctcgtgataatttttcattgacgaattgcgtctcatttatttctataactgcaatacgtttgaccaaagcaggatctactgaactaaacataggttttggatttaaatctataaattgtgttaatgtatttttgtgaacacatttagatttatttaaatctctacctaaaatatattgttctgtatattgttttatatttttgtttagaaatacttcatttcgattaacatcaccttccgaagcaaaagaaactaatttatcttctactttacctaaccaagagttgggtgaattttttggaatataattttgataaaattctataggaggttctaaaaacatgtcaaacaataattgtcttaataaatatttaatagtagatttacctccagaagttggaccatataatattgttataacacttttatgacaataatgtaacacagacgataaattagtttcaaaaactatccttttaggattagatttgggaataactaaattaaataattttaaaagaatattataattattttcaaatttaattttttcttcatcagacatatcttctatatctttataatcaattttaatatagtttagacgaatatatttttttgcattctcgccagtataaaatttagattcttttaaatcatatactccattattaaattgtataatataaggattaaaacaaataatatctgtattcatagataagttagcacttattctattttttgcttctccaaaaaatttttttataatataatctatatcttgtattaacatattgtttctgtatttttctaatatcatattacttattccttgaaaaatataaggattatcaacgattgcccattttccatttttccaataaacatatgcatcagaatctatctttttaataatatttaaatctcttataaaattagccaattcatatcctgataacgtaggataatcatattttaatgtattacaatttcttggatttccactcttaaataaaattattttttgttctgtaaattttataattctattatttttatgtaaagaatttttaccacatattttacaatcaggagtattaaatatcaaatttatatcaataatttcgtctaattcagcgctatgtttttttttaaataactgaattgaatcatcagaaattgtaattttataattattatataattctttagaaatatttctaataaaatgaggacctctaaaatatttaatatgaggataaattacatcaagatttgttaaattattatcttttgcttttattataatatgtggttcattaaaatttttatatgttattatatatttttttaaatcttctatattttctatattataatcatgctctgagtgaaaatattcactatcatttttcttactatatataaatcttaattgtgtatttcttctaaaaggagctaaatctatattattgattaaaatattatttatttttgatcttaaatttattatatatttctttaattgtataaatgatgtaggacttactaatatttgattaaaaaatatatgtaaagataatttgtgcggattatcagataatgtatagtaaatattattaaatataaatttttttatattatcgatgttatgattctctatatcaaaattattagaaaatatattatacaattcatatgatataaattttttaaattctttaatatattttttaacatcatcgatttcatattctgttttacaatctatatcaaaaaataatttaaaataatcagtaatatcatcaagtataaattcatgatattcagaaataggttgattgctatctttatattttaaaatacttctacatattttggatatacttattttaactaaatctttactagttttatcatttaatattaaatctattttagattctttagtaacatttaaagatttctgtaaatatatatattcgtctgacatttttttattttatttaaaatatatattttattttttcaaattacaaaaatttataatgtaaaatataataaagaaaaaatatgtattttacatttatttttagttattggatatatctttgaaatgattaattaaaattataaatgaatacttgtggaagttacggcgatgacatagttctggaatataaagttcctattagaacaaatgtaaatgtacaatctggtgctataacaagcaaaagcaacgcatattcaaatacaggaagaagtaattgtaatagttgtggaactaatggatattcaacaggagtaggatattcaaatacaggagtgcgatcagttagtaacacatggagcaataacaactgggataataatcctagttgtgttgttgagactagaggcagtaacagatatagaacttgttattatagagatggcacttcaacagtagagacttatccagtataatagataatatttttcatctaattaaatgaaaaatatttggagaacatatatactattaaattttatattaattaatcaatctatgactacagctacttctgatcataatgtatctatcgattatagtaaatttgattttaaatcgttattacctattattaacaatagtacaagtgtaggaatggataaaatattctattcattaatagcattgtgtacagtaatatttttaatagctatgtgtgttagttttgttacatcgttactaatatattatatttatgataattctaaaaaaaaaattataaaatcaacaatgggaattcatactcaagtttaatcattaactaaaaatgcgtttctgatattattataaaacttatcatttatcattactattatatcataataatttttgtattcatcttgttctaaattttctaaatttaaaattataatatttccatcgtctatatctgttaataataatacatgttttaacgaaaaattaaatatattatatatattgtaatctagcttaaataatttattatttatatataattcattattattgtctaatattgataatgtaactttattttctatattaatacattttattttattatatttttttattttattattatcaatagtattattatctattaaaatatcattttttgttatatatttaacaaatatttttttattttcatcttctattaatttaatataattagctatttgtgtacaatttagtaataaagatttccattttttaaattttatatattttttatcttcgatatcaattattatgttatcgttgtcattataaattattattaaaaaattatttataattatatattcttttattgtaaaattaaatttaaataatacaactttgtttaataacacatcataaactatatatatatcttcgtaattgtatgttttaaatacaaaatatttagtaacatcataaatattatcctcatgttttattaatgaacaatctatatcttgcaccaaaggcgctgttacaaaatttagatatatatcttttctattagcaataggttcaatataatgattattgtcgtattctattaaatccattataatttaatattaatttattttatttcaataaattattgaaatatattttatttactagtgtatttatatcatcaatgggatcatttatcggatcacaattatctatatcatcatacaatttttgtatattacatatatttttttctatatatgtgtaaattttctctaatttagattttgatgttatggattttatactaattttattttttccaaaaaaccttatttttttatcttcaaaaaatattgggtattttaatatactattagtataattaaaatcacaatgtatactaagcgattttatgtgtttttcgtttatttcattatttgtgtattcttttgttatagagaagaatgtttttaatatattagaacatatattattaaaatcttgcatattattttctgatttatcttttgataatattatctgtattttattattatcatataatataattcttgatctatttgaaacagttatactaatagaatttggtaataataatctaccttcagtaataattttttcattaattatttctaatattattttatattttattgtaacctctgatgttaagttattatattcagactctatttcataatatctagtatgattagtgttatttgatatattatgcacattatcattattaaataactttattaaagttttcttcttttcttttttttttttaataaaagaatcaaaactagtattgcaattatttaaataatatttaagatattgtgtattttcattttctttaatggcattaatattaatgcatttttttttattatttttattatttatattaataatatttttatatatttcgggatttatcaacgataaattaattatatttttatttttataacaacatctaacttctactatgtttttaatattattaagtttagtactagaatattcattattaattattatatcttcgcgaaaattagaaaataaatttttatatattttattatcaatcgaaaatctaaaatttactattgttcttttaatatcattagaatatgcgtagtttattaatgaatataattcttccattttatattgtaattatatattttcaattttgaaatcccaaaatattatcatattcttcccaataaattttttttctatcagatggtgaatcatttatatttttttgaatagttaaccatagatcgcatataacacattgaatatcattaataaatttacttattatatttttaaaactttcgtctattatgaaatttttaaataatccgtctattttatattgtcttgttttttcattaaatacaattgtttttaactgcgattttacattattataattatttgttcttaaattttcacatttaactataaaactatcgtttaaccacaaatcttcttttattaatgtaactgattcataaatatatgataaaatatataaataatgtataacagatgtagatattacacaaggtaatcttatagatagtttatcgtgttttttatttaacggatttaatatatcaatagtaacatctgttgtattatatatatttgtccaattcttcatcgatgaaccacttttttctaatttaatatctgttttaaaaagattattataagaataatcgtaatctgttttattttttttcttcatatcatcatattttgtaaaatatcctatattatcatttaatttatatgtgtcttgtatttctataactattgacaataaatgatatataatcccaaaatatgatttgggagaactattattataatattttggttttatattttgtattatgttaacacttggtaattttatatttatacccgaagatataatagatttggttatatcgagcatttataaaaattataataattcaagatataaaaacaaaaaatataaaaaatgtgctaaatattaaaattttgtgttaaatttaatatttataagtgcaacgtgatgaattattattaatttattttttttttattaatttttcataattcgtaatattagaaataaacaaattcttatattaaaaaataaatattaatggctcattccagaaatatataaatccaataattttataaataaatatatttatatactataatattgaacatattttattgtatatattttaaaaatagctttataagatatgtgaaagttttattaaattgttagatcaaaaagttataaattttacatttatacccataagtaaattaatatattataggatattatatatttaatacttacatattaattaagacattaacacaaattaaagcataatattgtcaattttatcaattgctttttttttaaaaaatatatcagtcattttatatctacacaagtaatatatcatagtatcaattattattgctatatgaaattatttataattctatattaatcgacacccaagtactaaaaataagtaaaatacagatataataattattatttgagatcaacatacacaaatgtgtttatattttaaaattaatatttatagctaaataatttatgttaatggcaaaatttttggctgtaagtaaataaagctataattaattaaataaacaaatttcaaatattttatggcacatcaaaaagattatattttttttttttaaattattatttttacatttacaagtattgaaaataattttaatacttgtaaatataataaatataataattaatttttatttattataggtattgacttattattaatattcggaattaaaacatatttatgtttatgcttattatctccgttatcatctctaattttttttataataatatgaataggtttcatgtctatttcattttcaattaaatcaaaatctattatttcgacgttcttattagccatttttataatatataatgattatattattattgcatgcttgctaatatcattattttatttttttttttttattatattgtattatttaatacaatataataaaatatatttaaaaataacatgtacgtatatatgagattatctgttattttaagactatttatacaccctttaatttaacaattgacatatatacattaagatggttgatatttaattatcatatttcaatattggcataaaaataaaataatcttttatttcatttttatgttcatcgcctatcattccaggataaatacataacccatttaaattttcattattattattatctatatttgcattaaattgtaatgaattatatatttttttatcttttgcagaaaaatctgttatacttatatttaatttttttaataaacaaaattgttctgaagatattttatatttactatatattcttttataagtttgtaaaatactacaataaaacaccgattcgtctattatggaatttttaacattatcattacgatatgcagaaaattttacataattaggaaaaaattcaatttcaacactcgatgtttttgtagctattaattttttaataaaatttgttaaaataggcatatctattttaaatattaatgcagtattattgtatccagatggatctaacatatatttatattcattatcttttacatatgtaaaattatcatatgccatatacattacattagagtaacctgtgtcatgtaattgtgattttaatttgtctgatataattttttctacatctgataattttggttctataggaacatttgttatagattcaaacatattaaagtaattatcaattttttttgatttgtatgatattgatttaatatctgtataatcgggagtcatataaaatacattattttgattatattcttcttgtgtcataataccagattcgttaaacttaagtattattgtatctgaaatagaattttttagtgtcaaatctcctatcttttcatataaaatgttaaaagataataattcttgtatatttgtttctaaaaatggtattctgacacatattttaaaatcagatgttattactatttcacattttttaccatcgcaccacaatgtaccatatggattaaaaatacttaataattttattctatctcgtaaacattctattttaaattttatatacatttagtatatatatacttttttaagattatattattttaattataaaatgtgttgatatattttttacgtataaatgaacgaagataatattattaagcatttgagtgttatggcattcatggatagttctaaattaaatatgttattgagtactaaatcagctggatcacagaatgattatttaaaagaacacagatggtataaaattaataatatgaacatggctgcgttagcatacgaagataatggcagatatttttattctaaagttcatttgataaaagattcagatgataatatgggtattaatagtgtagatgcttatggaggacaatcaaaaaaaagaggaaaaaataatccaaaaaataataaattagttaacgcaaatccttcaggtaatggtagaagaaaaaaaaatgtaaaaaaagcagcaaattcaactgatgattcggatcataatacaaatttaatgggagaatataacgatgaaaaaaatgagtaaatagatatttatactcttttaaattttttattaactatgtttaatataggttttactttatcattaataaatatttttatttcatctattttttcatttaataattcttttttaatattaggtatattacttaaattaatttcttccatcatattatctacaatatcataaatattatttttaattgattgtgataatcctaattcatttaatttttcttttattattaattttatatcatttttgttcttttcatataattcgcttaatttttctttattattatataattgtgataaaatatttataatatctattttatctttatctatgttaatatcaagtatattctttaattcacccaatttatcattcaaatcagaattagtaaattttgttttatatttgtcatatattttatttttataacaatacataaaaatatttaataattttattaatatgtgaattatatgcaatctaatatgtaatggtttatatccattagtattatcattatattttatataatttaaatcacccatatcacattcatatatattacttgcttttttaatctgacaacatttaaattttatattgagattattactaaaagataaaatacatttatttaaaaattctgacgtatcaaataatttactaatgaacgaatttatataatcatttaattcgtgcgtacatttaactgtaccaatattaatattcattaatataataaatatatttctggcttcctcaatataataattattatcacaattttcaaagggtttattaaatggtatataatcatttataatttctataaatattttacgtatttcttcatcatagaaaaataagtcaattaaatttgctataaacgttggttctttataattattcatatttttaatcatattattaattttaaaattgatattttcagaattatttacttcctctttggctttacaaataattttttgttttaaaatatttatatttaatttattaattagttctttatattcatttaatataatttttttattttcttccgaagatatattatatacataacttagagttccgtctttattattaaagaaagaaaataattttaaatagatgtatttcattgaattaatccattcattatcatcaaaatttctaaaatcattttctttaatgtaattattaataaaaatcctttctatatacattttatcatcatcataatttacttcttttaattttatttctggttttttttcattaatagatagtataatagtatttgctaaattaatatagtgtttttccatatttattattataatattttttttaataatttctattatttttatatatagataatttgatattatttaaaactaatataatataatcaataatattatatttattatttattttaatatttatccaatctaataaatgatttaataaaataggatgtagatatattccatttatattatcatatttatcaactattttatattttattttattattattattatttttattatttaataaattcatataatattttattaattttatagtttttttattattaagccaattatttatttttctataattttttatacacacatacgaagcattgaaaaatccagtttttttatcaattactaattgataactatttatatgagcagaataaaatgtattttttattttttcatcatatattatagaagacattttaactattattatcttattttatttttcaaaaaacatattttttacatttaatactgtttttataatatgttttgatattgaatttttatcaatattatttaaatattttaataaattattgtctgaattatgtctatatttattatctttatatatatgatacgataaatcatgtaataaacattgattatcaatttcattatatggcttaataccagaaattatattttttattacatttgtgtaaggaccacaatagttatattttaatagatgtaatggggtaatttttttatttttcatataatctattgggacattaatattatatgcagtagtatgagaacatttatcacatataatatttaataatatatattttttattttcggaaataatagtattaaattttgttatatagtaatttttacacatttcgcattccatttaaatatataataaaatttaatttttgtatatatatttataatcataatattccatattaaatttatctaaatctactacattttcaaagtaatatattgtcggatctattatattttcttttataaagtatttatttttatatatttttatgtatctaaatggaataaataaatcatataacatatccatattaaaatatttatacccttgttctaataatttatgtaaatttactgtagaatatttattcatcaaatgtaatatatttttagataatctattatctcctaaacataaaaaatcatcaatagtgaataattttatcatattaataaaatcaatattactacaataatttatatcattatgaaagtataattgaaaaaaatatttaaaattgtataacgaaaaataatttatatcttcaatataaattttatattcattaaggtaaattatcataattaaatacttttattctatatattttttttaagcatttaatgtttaataagcaatttgttattcctattatatatttaaattcagtataacatgtaacatctgcgtctgttattatttcttttatattattctggaaatcttcatttttagaaacaattattatttcagatttattatttataaatttttttaatttacataaatctattttatctatttgatcattggatattaatattaaatcacaatcttgatcattacattcgtcatcatcgtaatttgttattatatatatgctagattcataagataatatttcatcagatattatcatatcatcatttgttattggtatattaacatcacacgacaaatctatatctttatatgattctatatcattaccgcaattatatattataacataatctgcgttagacattattatttttataatatgaaattatactttcaaaattattaaataattaaatggatataacagataatagttatgaatattcgacaataaacccacaagttatatttttatttgatgaaaacaagaatgttaaaaagacaatatttttatctaaagatagtataatagataatagttttgcatatggagtatataattatttattatctacaaatacaaaatttctatcacaaccagaatatattaatgatcatgttatattatcattcaatcttgaacaagctagaggatacattagaaatatattaagaattaacgaaaatattattttattttcaatatggcataatttagattattattataataacaatgaaatatttgatccatataatataaaaaataatttattaatagaatctaatgataataaaaaaatattatatatgttagatattagtattactaatggtgctatattttgtgttactactaacagttatactaatacaaatttagctaaagaaggcatatattcaaaaatttatacagaatatatacaagaaataatatttaatatatataaaaataactataaattatcttccgttgtaaaagaatcagaagaatattctttaacaaataattttgatgatataatcaaattatcaaatattaataaatataaaaagacattatgtattggcgtatatgataaatattatataaagggtgataaaatatcaatcttggataactacaacgattcagaatatacatcattatacatatatatagatcaaaataatataataaaaatcactaatgatgtattaataacagaaaaattaacttattttacagatatattaaaagaagaagaaataaaaaatataattattaaatcaactagtccaaaaagtattatatatatatattttgatacgtttttagactctaatataaatatacaatatgatcttaaattttttctaaatgttacaaacactagaaatatatttatagatatgtcttataaaattaatattatgacatctaaaaatcacatatcatttagatcttttaacatagatgtaaatttatgtaaatatttatcgttattgatattaggatataatcatatttttaataaaatacaaaaacacgctagacttaaaaaaattgatgagctttatccttcgaggtattgtcaaaattataaagatgttaaaagacaacctgttttaatagattcgatagatgaaaattatttaattaaaatatctgataaatattatgtgggtaaagaagatactacaaggacatatcaacacaaaggaactaaaaaaatatttgatccatacaaatacggtgatgtttatatagatgataatggtttaatatatcaatgttctagtatttattattcaaatatgggatttttgaataatatatatttagctagtggaggaaaaacttgttatccttgttgttattcaaaacagaaaaatagagatgaaatattcgaatcttgcgtttataataaagaaattattttagaagataaaataaatcccataatagttaattatggaagaattatattaagtaagaatggtttatctaaattatcacctaaattaaataatattttaaacgctaattcaaaaatagatattgttaaacatactaatagaatagatttttcagataattatacaataataatgtcatatcaaccaactattactataagaaattttgatgacatgtattattttattataaacaataatgctattgttattaatgataatatagtttatactgataaaagtatattaaaaatgaataataataatataaatgtatttataataatacaaaatagaattcatcaattaaaaaatattgataaacaatcaaaatatgatgatatagtagttaataaaatagatgataaaaaaataaaaataattaaaaaatactttaatataatatccaatatacgaaatccaatatctaataatggaatttctataacagatgatgtttgtactatagatggtgaattaatagaaaataaaaatattaaatatttttctgaatataataatatttctttaaaacctaaaagtactagcgaatatatagaaaagtattttaaacaatattttgatactatatatactaataatattagattatttataaaaatatttataacgaaaataatgcatagtataaaagaaacagacattataaaaacagattatactaaattagaagaaaaattaaataatattactaataaacaaatgtcatctgttatattgtcaaaaaaaagtatttaataattaattaaatatatattcaagatctggattaatatttttaatacataatatttttgcaatattttgtttatgatttatattataaggcaaatctgaattattagttatgtataaaattatattattatcattgtttggaattatatattttgatttcaaatctatcatatttgaatacaattcttctacgggagtaattataccaataatatcattaggtataattaaattaattcccaaattaactttacatgttttatgtggaggaatggttatatttatattgctagataaatttataaatttattatcaatgcacgttggtactgaatgtttttcatcagtattataaattaaaattttatttttatttttaaatttatatatataatatgaaatataataaataaaattattaatgttattccatatcacatttataataaacatttttatataatattgttatttttattacattatttttcaataattctaatttttttattcaccaattgaaaaaaaactaacatattttgtctataatattaaaatgtatatacattttatattaattttatataatataaaatatattttatgttataattatttatctttgattgatgaaaaatctattaatgatcaggaattatgtattagtgattacaaaattatattaaataaaaaaaaatgtattcatgattataatgataataaaatagaatgtagattattttataaagaaattaaaaaatataaaactataaataacgaagattgtattagtaattgtggaaattttgaaaatactgcgtatcaatggtgtgttactaaatcatttaattgggattattgtaataaaaatatatcaaaaactggaattttatcatatagaacatataataaatatattgcttgttctgataaatgtgacaatagaggtgataaatattattggtgtaatactataggcaataattgggcgtactgttatcctaataaaaaaataattatttttaattatagaaatgaaaaaaataatgtgtgtgcaagtccttgtgaaatatattcaaaaaatgttgcatattgttatgataagaacaaaaattgggaaaaatgttatttaaatcctgaatataaaaatactttaaatgattacaataataaatttatatcacaatgtaaaataggaaaatatacatccgatggatataaacaatgtaaaaaaaatttatcatttatgtcatgtccgttaaatgtagaatccgttgctaaacattacgaagataacaatccaagtataataataaggaatatagatccaaataatattattactttatctaaaaatccaataatttcatatactgtactacctacttataattattttggatctatacaaataaatcttccattaatagtaagagcaataattaccaatcatacattaagaaatccgagagaaatagaaagatttacatcagatataaatgcttattttaataatatgaatcctaatttagataatataaattatgataaaaaaggatatttattaggatataaattaggtggacctattgaaaattataatatatttccacaagcgtgctcacataatcgcggaagtatgacagtgtggcaatatatggaaatagatttatataactttttaataaataatcccaatagatatatagaatatactgccataatgaattatcgcacagatgatggaatattaaattatagacctacttctgctgcattaagaattagattatatgataataatatactcgttgatataagtggaagtcccataacatttattacgaattcattagaaaatatatattataccaacaaccctgatcataattgtgaaatagaagattaatattgaaatttttataaataaaattaaaaatatataaaatgtcacttaataatatatgttatgaacacattaaagactcatattattatggtctatttggtgattttaaattagttatagataaaactacaggttgttttaatgctactaaattatgtaatttaggtggtaaacaatatagagattggaaacgtttagaaaaatctaaagaacttataaaaacattaataaatgtcagacgcgagaattcccgcgtctgggaatataatataataagtaataataatcacgaaatacataaacaatatactggatattatgtatcaaaagatctaatattagatattgcatcttggatagctcctgaattttatttaaaatgtaatgatataattataaattattataataatgaatttaaatctttatctaaagaggatattaataataaaattaaagaagtagaaaataaatatactaatataatagtagaaaatgaaataactattaaacaaaaagatgataaaattgatgaattgaataataagttagatattatcataacaactaataaaattttagaacaaaaatcaactaatttagaaaatattaataataaattacttaaattagcagagaaacaaaacattaaattagatgaaataagtgatgaattagatgaaacaaactataaattagatacattaactcaaacagttgaggaaaatatattacctgatagaaatatacaacctaatgatattaatttaaaacataacttagttatatataaaaaaataaataatataattaaaataactagagctcaaaataaatatataaataaaattaagatttcagaagataatataattataaaagagtacgtaccgaatcctatagattttattaatcgtatgaagttatattgtattgatttaaataaaaaaataaaattaagtcttagaaaaaataataaaaatatatcatatgatgaatttattgatatatataatataaataaaaaatttgagataaaatataataatattatattaaataatagtaatttagatgatgttatattgttatttaataaattaaaagaagaacaatataattattgaatttttataattaaaattaaaaatatataaaatgtctttaattgatgtatgttatgaacacatcaaagactcatattattatggtttatttggtgattttaaattagttatagataaaaccacaggttgttttaatgctactaaattatgtaatttatcaggaaaaagatttagaaattggattagattagatagatctaaacaattattaaaatatatggagaattaccgaagctcatatgtgagcgttggattttatgaagttaaaggtgataataataacaaaacatctaaagaaattacaggtcaatatgtacctaaagaagttattttagatatatcatcgtggatatctgtagaattttatttaaaatgtaatgatataattataaattattataataacgaatttaaatatttatctaaagaggatattaataataaagttaaagaagtagaaaataaatatactaatattatagaagaaaatgaaataactattaaacaaaaagatgataaaattgacgaattgatacaaataaataaaagaatcgaagaacaaaatataaaattacttaaattagcagagaaacaaaacattaaattagatgaaataagtgatgaattagatgaaacaaactataaattagatacattaactcaaacagttgaggaaaatatattacctgatagaaatatacaacctaatgatattaatttaaaacataacttagttatatataaaaaaataaataatataattaaaataactagagctcaaaataaatatataaataaaattaagatttcagaagataatataattataaaagagtacgtaccgaatcctatagattttattaatcgtatgaagttatattgtattgatttaaataaaaaaataaaattaagtcttagaaaaaataataaaaatatatcatatgatgaatttattgatatatataatataaataaaaaatttgagataaaatataataatattatattaaataatagtaatttagatgatgttatattgttatttaataaattaaaagaagaacaatataattattaataactaatgtaaatattatataatataaatgttaccaaaatattggggaagaggagcgtgggttgttatttttacaagaatatattatacaatttctactttaaataaagaaaattatatacataatgttgaaaaattaaaattaatattatatttgatatgtagtacattaccatgcgaaacatgtgcagctgaagctaaaaaaaaaatacaaaaaaataatataatgtctgaattaaatattaatagaattttacatttttatatagaattttataatatatttcataataataaaatagatagaaaaaaaataaaaacatatgatacttttaactatgtataaataataacatggatgttaataaatatatatatgaatataataaaccactatattatacttattatgatttatgtagaaatatgaatgatgttatttatgattataataataatactattaaaaaatatatggatatattattatcacaaatacaatttttatccaacataaatattaaaaaaatatgcaataatactaatggtatagttaacatattatatattggatcttcaaaagcatatcattttaatatattaaatgaattatataaaaatttaactaatattcagtggtatttttatgatattatagatccgtgtattagcgtagagagattgtcttataatattatttttaataggaaactttttaccgaagatgatattatagattttaaagataaatatccactaatattaatatatgattatgatgataaatctaacgttagagatttattatatcattataatatgcaaaataatataataatatatttaaatccgacatattcgttgttaaaatttaaatatatgcctataaataaatggaataattcttttaatgattatgaatatatttcaactggtataaaatatttaccaacaataaaatcattacatactagaaatattatagataataaaaatataatgacattaacatttgatgagatagaatctgaaaattattacgaaaaaatgaattactataataattgttctggatataacgatatatataataatatttcaggttatatattaaataaatcaaatttatatgacaataataattcagcttataatatattaaaaatatatgaaaaaaatataataaatacaataaacgaagataaaatatttagatcaaaagaaaaatatatttaactaagaaattctatcatataattatataataaaatactttcatctaaattatttttatttgtttcaatataatatttatttttatcattaactatattatatattgaaaatggtacattgtgaataaaataaatttctattttatcttttaataattttattacatctataataaataaattaactatatcagattcttcaaatttcatttgtaaatataatataatagtatctgttaaatttatttttttattaaacaatgataatgattcttctttatctaataaaatacaatatcttatattatcattatatttaataatatttttgatataatattcatttacatttaaaccatatttattacttatttttaatattttatcaatcattttatatataatatttattcaaattatttaatatttttttaatttctattataagatattttttattatattttgctatgttattattaaattttattaaatatataatattgtttaattttaaatcaattatatttttaacatgcgaaaaataaatatatggtaatattttatttatagattttttcaataaaattatatattgttctaaatatattaaatctttacctatattagattttaattcatctacagaatctataaattcattaattattattttatttttcattttttttatatgatatgaatatttaaatttatttatattataatggaaactatcattaataaacataataatatttaatagtaaaataaatttttataaattagtttcacttatattaatagtatatattggttttttattataaaaatataatattatcaatataaatataaatattattaaaataaatataacaggatcgaaaaatactccccatgtttgatttatttttatatcagtgacatttgataaattttctgaatttattactgtgcttgcgtttaaattgtttatacaattatttattaaatcaattttattattacctctagttaacaatgatcctatggttataatacaagattgtatattacaatttttttttatattcatctgattggttgttaaccatttttgaccactataagagacagtacatggcgctaaccaacattcttttggacccaaaacttcttcaacatctggtataaattcagtaggaggattataacaaaaacataacgaattattactattatttttacaccagtttgacaacgaatcatcacaatatcctggata

SEQ ID NO: 25 - DNA, 50000 bp, Amsacta moorei entomopoxvirus
tccattttctctcgcatacacacacatataatcacaatataatttagtatgatctatactacataattctgaatataattttaaagcaatatcaaatgttttagattggctatacatccatctatagcaatataaatcttccggattttgtctgcaaaaattttgcattgttacattacaatgtggtgttgtaaagttatttattaatgtttcgtgacaaccagatgttcttttaccagtacaacattcccgcaaatcattttcatatattggatatcctctatatcttattttacatttatttccaacaaatgttctaccttctaaccattctgaattaccatataatatacttcccggcctaaatgttaaactagtacacggcgatccttcgttagttattacataattatctaattcgcttgtataattagacaaaatattattattaaataataatgcacattctgccaaagaattaaatggagttccaatacaataatttatttcatattcgtcgagattttcataagccgatcttggtattctattaatttgttcaaacatcggaactctaactatgttattatcacttaaacctattaataaatttttatttccattattattattctctggtcttataaacgatatacttactctaccacccatttacattattattaattttgaaataatataatatataattgataatatattagttttagtgttataattaatattaatgtctactaacactttatgtataataatgccaataacaatagatagtattgatgtaaataatgacaatattaatatctgtgatactaacataagtaacgtatcaatagatacaattttagatgctattaatgataatttagattttaaagaattaataaaagacgaaattagtaattaagtttttaaagttgaatctctactaataaagtatgttcaatgttaataaaagtattaactctgacaaatgtattttaatatagtattaactgacagctcgaatattttttatatatttattatatatagattctatataattatacctaaaacctgcgctagtttttaatccataatctactatttttattaaatctataattttatatatactatgtggtatatatttatttttattattttttaattcattaataacacgtttattaataatatttaattcatttatttctatatcatttaaagtattattaaaatcatatttgtataatactattaatgatattgtcatattgtcggtactttgtttataaatacaatattttaatatattttcagttataatagataaattaacattaatttgtaaattatattcaacgtaattgcataattcattattatcaataacattagatataccatctgttataagtattaaaaatttgcacgaattaatatccataatttttatttctggtatggatattattgcatttttatatggattttctttttttttaaaattaaaatctccaaaacatctagatatatttatttgaccgtttattctactattaattatttgattaccacttttaagtattctaattctttcttttttattacatggtttgaaatctgttgtttcgtatataatatcacgaccattatataatatagcttttgaatcaccacaatttaataaaactatattattcttagttaatataacacaaactaccgtagatccttgaacgttactaagtaaaatatttttttgtatatttttatcaaaagatataaatatattatttattatttttgatatatatttataagtgctagttaatttcagtttacttatattttttgaaatatattccaaaaaataatcacgcatatatgacgaaacacaatctccaccatgaccatcatataaaccaacatatatatatttctgtttattatcataatatatagaataataatcttccatattttttctatatccttgcattgacatgttttgtatatgtatattatgtattatatgttctgaatttatacttaatataggaatgtttaattgattgcccatttaataattaaatattgataattagttaaattatttatatttaattatttttacattataaatggaagaagcatttaaatcatttcccacgattaatttggatgatttatatatcaatgcaaatagttattctagaaaagttaaacacgttttaaataatttacaaaataaatatgaaaaaaatccagaagaaacattacaatatttagaaagtttatctgctggagctaaaccacaaattagaaaaaaaccaaaagtaaataatacaaacaaagaaaaagttaatgaattagttggtgaatatcaaattgatagtgaattatattgtcttaaatgtaagtcaaaaacaggtaataaatcatcagcaaaagtatataatactggtaaagctcttagattagaatgcgaatgtaataaatgtggaactaccaaatcaactttcacaaatgaaaaaaaattaagtaattctaaaaaaataaaataattatttatttatttgtattacagttacaacaattataataatctatattattaatatttttttgtgttataggatgtatataattatctatgatatattttgtataaattattttataatgtgatttatttatcacattattataaattactttatttatggattctattttatctagatgacaagtaaatattttataattagatatataatataataatatgaaaacataattatctatttttttatatatatcaaaatgtgttggtattgttgataatttatctttgttatttatagataatcttaaatttataataattattcttggtatgatttcaaagtactttaataaatttttgcatatattattatcaatagtgtatacccagcctcttattatatatgatatatcatattttgggtaattgatttttttttttaatatttcgcttattatatttatattctcatttatttttttttgttttatttctaaaataaatttatatttacacatagcagcatttaatataattttttgttcatatagataatacatagctacataacaaggtaataatgttttagatttaaataaatgtaattttgatatattgttagtaaaaaatttatgtattttatgttttgtattttcatctaatttatatattaattttattatattatcaaataaatttttatattgatatatatattctttattaaagacaataaattccttacattcatcttctaatggtatattaactatattttcttctatattatctattgttaaaaaatctgacgggtcaatcatattttatatataatttgaattattaatatataataattcaaaaatgatgaaatatctaattatatatataaaagaatgttgttttttatgttatgatgattataataataaatttaataatataattaactttatctggattatatataataatatttattgatgattgatattattagaatatattataataaatggataaaattatatggataataattttatttattataataatatttatgatattattaaaaattatagatgtgttatgtaaatctgatacttttactctagaatatgaacggttataatattattatcatatgatatttttttaacaatagtttgacaaatttgtaattctttgttaaataaacttcttggatctacttcaggaaattctttccaatctatacttaaattaacgcatctaaaatttttagcagcatcggctattaatctagatggttcaataaaaattatattatgaagattaaatctatgtaaaaatattgctgggtttgaatattctgatgttggcgtaactgcaaataaattatcagattgaaaatatgattcaatatttacggtatcactgttatattcagctattgattcattagaactacttgttatagatctgctaataattcctaattcttttgataaaaaatctaatccaaaaacaaaaggatcatttacatatatatctgattttttagatttaatagatctcaaatcacccgtagaagtattctcatttgcattccatatactcaatggaatactaacgtcagatatgtttattgtatgttttacttcgtgtattaaaatcttatcttcgttaggtatatatgttccagatattttactaaattttttagaaatattataatcatttgggttatttcttctactgaatgataatatatttgtatgataatataaatcaaaaccttccgggacattcattatattaatttcacaattattattaacatcaaacacaattttatcacacggatcaatttttttaaacttacatttatcactaaatccttttgatttaataaagttttcatcatcagaaataattaaaagatcttttaataatttatcaacgtatgttttgataaaattttcttctgtttctggataatcgggatatgatataaacatatttcctctgaaaatatcagatttagaataccataatagattagttatagataaaaattcaggtgaataataattctttttattacttttgtgtgtagaataagttaattcttctatatatctatgtttaaaaggacttccgcacgtattataaccagtaaattttatatatggttgtagatcaacatctgaaatatttttaagactatttttcttatattttacatcgggtaataaaatatctgcaaatggtctaaattttatttttatttgtaatttagtttcagggaataatctaaaacaagttctgggattcatattaacattatcaaatataaacattagaggaaaatatacttctttagatggaaaaataatatcatcagcacatttaccatatttaaatttacataaatcagaattattgcctacaaatctcgaatattcttttttcttctgtataaaatccattaaaaattcaagcccagtttttctaattatttcgttagttttattatcatcgatagtttctataatacattcttcgataagtttaggaatgaaataattctgaaacctaacaccacctataccttttatttcaggcaaagttatatttaatccaaaattattacagccttctaatttaatatctgttatagaagctactgcataaccatcttgaaacgtacaaggacttgatacatattgtggtatgttatatttaccatttttagtttctgttatataaatattaggcctatctgaatctatattagttttactaaatggtataaacgttcttttcatatttatattacataaatttttaatatttatctataatacatttgtcatattattatttttataaaaaaatatatatatttaagtaataacgatagtttctataatatctttagataataataaatttaatttttcaaaattattataaattttttttttatagtatttattttttatattatatatttttattacatttcttaatataaatttatatctattgttaaaatttttctttacataagttattaatgattcgtaaaataccggagaataacattttgcagcaagaaaatctaatatatattcgtgtggacatattattttataatttttgttattttcaataataattaattgattaccttctactattatacattttattaacttttttaattttattaatattgttattattttatatatagccttatcattattcgatattacattttttatattgtattccagaataaaatttattaatttaatagtacatatatcatacataatgatataattataattatttactaaaatttcaaaatatattttatgaagatattatattaattcttctaacaccattattaaaaacatcaatatttatattatttaatttaatagctacattatcccacggaccatataatataaaacctaaatttttatttaattcaaaataatgtattccgtcaggatcaaaatcaataggttcgaaaatatattccattaattctttattttcgcgtctttcttttatgtgtatcaatccatcgcatattgtattagcatctggtcttattataaccgaagataaacttcggttaatggaaaaacctattattatatcctttatatttgtaatattaatatctatgtaaaataataaaaatcctctttgttctaaaacttttatattataatttgtctcaatgtattgatcggcaatatataattttcttttattatcagatatattataatctgtttttatccacctaaatataataaatttcaaattatttgcattattattatttatagttatatgatttatacttattatactactataatgtataatttcataggattgtaatcttccgtaattaaatgtaaaacttttagcagaaaataaatctcctgtgtataatctttctccaactattgcgtgatctcttccgttgatttcaattaaattatcatttattaatatattttgtatattatatatagtatcattgttattattaataatattataatattctaatgaattaggatccattatttgtatacaacatttgcaaaatctagtagatatattcaaattatcttcatttccatattcgtttaaataacaaaaactggtatagtttgatgatactacagaaaatccattttttctacatcttattataccacttacggttaatatatcatagtaaactatatcatcgggttgataatcaatattattttctattgttggatataaatttaaatttaatatagaattataatatattgtgttaatattatttattaaaaatttaatattaatagtactctttaatttattaaaatgtgttaatatttggcacattatttgtaatatttgtaacttggttttatttcttgtaaacgacatacctaaattatctatattacatccgtaataattaaattcattataattcatattaataaatatatgtaataaattatcgctaacaggaatttttaatatatacatagcataaaatatactatctaaacattctgatcctatagatattgcacttggtatcattggcaatgaatttgtaaaacttccatcactataataacctggttttaaattttttaatgtattacatggaataatttctaaatcttctataaatacatttaatgcattttgataaattatattatttatatctatgtttaatgaatattttttatttatagttacgattataatataacataaacatttactatataattcagatacatttttatgtgattgtaaaggattttgtatccattttaaaaatttaataaataaattttttattatatttagatctggattttttatcatatatattgacatacatagtgttctaggtatacctactcgtgcataccaattatttatgtctaaatctgatttattaatattatatagtatactaaaatcattgatttttcctcgatttattaaaactttatatgaaaattctgatgcagaaaataacatatctttgggcgtgttaaaattattattttgtatatttaatatttttcgatggattctttgtaaaaaatatttattataattttcattgtaatcattaataattctataatatatcaataatattaaaaatattattataataacgcacatatataaaaaattcatttatataaaaatttatatatattttttgtttatatttataaaaaattaattaataaaatattaatatattatcgatgaaataattattctaatataatatctaaaattaatataatcaattcataataataattattatattctgtaaaaatattttcatctaatctccaatttaatatgctctgttcctctaaaatattataaaaataatccaatttacatacttttatataatctaaatctaattttaaccacttattttgtaatctatatttgtaaatattttctatactattattttttaattctatttccataaatttaaaaaataaatcttttacatataatattctatttgtatatttttccattttatatttcaaatattgttaattaataaatcattcgatatgtttttataataataattaaaatacttacatgaaaaaattacttataacattagaggtaaagataaagttggaaacacataatgtaaaatattaattgaaaattagaaataggaatgatattagataaatattttaaatataaaactaaattatctactaatatatctgatttattattttttataaacaggtgataaatattgaaataagtgcaataaaaattaaattatggaataaccttaatagtaaatagatattatttttttagttcagtatattaggtctcgcaaggtttagatttaaaatgatgtaaaaatatcaataatggattattaaaacccgattttagtatttctatttatacacaataaacaaattgaaaagaaatatgaaatgtacaattgtaattttattaaattatataaaaataataatatatttaacggcaattataaaataaaaaatataaagaataatatattaaaaatagtattaaataaaacaatattttataaaactatatattattattagataatatatttaatgctgtttgacacggatgactaaattcaaaatatccactatatcctaacttattaaacatatcaataccacattgtgcagaattgctattatttgtccatactatatattcacaaaattgtgatgcgggaacatctctttcagcagcttttctaaatctccaaacatcacctattcctctaagaataaattctggtaaaaatgttgtttgattcattctcatagcagcgtaataatttccaaaatcataacatctgtacgtaaaagcatcatttactaattgtaatgatcttgctctacctctggtcatttctatttgtgttttctctaaaactaattgtttccaactgcctatatttttttttattcttctaaatttatctaactgaaccagaggttcccatctaaatgattgtaaaataaaaaatatagtggatattataataaaaataattgttaatatatatcccatatatcctttaaatgtttttaatttagatgctgccgatctataataatctatatttttttcacctatttgtaaaatagtattatccatttaataaaaaattattaaacttgatcatctttgatgcctatataatactcgatatatttgattttatttttagattttttttttatatatataacgataataaaagcattaataataataaataatattattggtattgatataggcataatataatatgttttagtgcaaacgtttattatgtttttgttataatagtaatcatcacacgaaatattattattagatatatctattataatatcatatttaggtaattttatataagataaagaattattttttatatctaaatattttaaattgggaattttaattatatattctatattataattttgtaaattattattgtctaaaaataaatttttaactgaactattgttaaatttaaaatttttaattttgttattactcaagtatagattatctatattaacattattgattagatttatatcgattatattattattttctaaatataaatattctatttttaaattatacaattttaattttatgttttctttattattattattataaatataaataaatttaaaatatttattattccagttatttattaacttctcacattctattgatatattatataatattttgggattagtatttatgtgtatattatttttatcatatctgtcaaatgtattacatatatctttccaattaatatctttcgcattaatatattgtaattttataaacaataaatataatatataaaataatattttaatatccattattatatactgtattgtaacaaacttaaatatttaaattattttttcaatataacaatcaatatattctacaacacattcttccataacatattcttcttctataatcgcatattttatatctattttattttttttattacaaaatatgttattaatgtgaaaattaaaaatatttacaattatcaatgcttttaatttcatgataatattacacatatataatatatatatatatatataatatattaattaaaattcaaaaattatatatgaaatattatatttatttgtaatcgatactattttgaaaatataattaataatattaaaaaaaaaatgtattttaatattttaaatggattattatggaaatattatattataaaaagaaaaaaatatatttatgatatgttagaatatttattattaattttgttttttacattactatatagttttaaaaaaaatataaaatattatgataatgatttgaataatataaataaaattaataataatacaaatattatatattatccaaaaagtaatatatctataaaaattatagaaaatgtagccaaagaattaaaaataaataaatattatggttcaagcaacgaaaatgaaataattaattttattgatactaatgaaacaatatttattttatttaataatacatgtgaaaacttattatatactataagatttaataataatgaaaataacgatagattattaattaatatacaatggttaattaatatgaattatttaagattgttatcaaataaaaatataaacattgatatagatataaatgaatacatatataaaaattttaacacaaatatattattttatacatattattcgatattaattattgcatttatatcatttatattaaaaaataacaacgacaataatgatcctatgttcaaaataataaaagtgccaaaaatattaatatatatatccaattttatatgttcaataccatttggaattatttattcagtatttggtacaataatattaacaatatcagaagatccgttaataaataataataataatattataatgtttctaatattattaatatattttatttccgtaatttctatggcttatttgtgtaattttttcatattattaatatacaaatataaaatatttgttattatgtgtgtgtatgtattaactattattcctattacattatataataatttaaattcagatataaatatatttataggtttaattccacacattcctttatattggatttttgaccaattaaattatgtagaaaaacaaaataaaagtttaacatttaataatattaatatatcttatagtatatatagtaaatctatcttgatatctattatatatttaattttgcaatcatttatatatatatctataatacatataattaaattaatatataaaatatgtaaaaaatatatgaaaatgaaatatatatatattataaatgaaaataataattatatgttagaaacagaaaataatgattattatgttaaaatacaaaacatatataaatattatgataataattttattttgaataatatatgtttggatataattaaaaataatacaacagtattgttaggaaacaatagtgctggaaaaagtactttattatctattatattcggattaataaaacctaataagggtaaaatattaactaataatatcaaaataggttattgtccacaaaataatataaattttacagattttactgtaaaagaaaatatatatttatttaatatattgagaggattaagttcgttacaatcaaaaataaaaacaaatgaaataattatttatctaaaattacatgatatagaaaattgtataataacagaattatctgaatgttcaaaacgtaaattacaattagctttttcgttaatagatgattctgattttatattaatcgatgaacccacacataatatagatttaaaaagtaaacaagaaatatgggatttaatatcattattaaaaagaaataaaactatattaattactacacattgtatagatgaagttgaattattagctgataacttaattatattaaacaacggaaatgttaaatataattcgacattatttaatattaaaaaagatgcaaatgtaacttataaattatcaatacataataattctaccgacgataaaataaaaaatataattattaatagtggatttataatattaaatattaataaaatagatgaaaataattcaatatataatatttataaaacagaaaattctaattttttaaaattgtttgaattattagaaaatgttaattgcgatataatatattttaaatcgaatactttaaatgatattttatataaattatgttctgaagatattataattcccgatgatagttatataaataatttaaattataatgatatgtttatatctgaaataatgggatttaataaaattatgagacaatttatagaattatttaaaagaaatatttattatataagaaagaatatattattatttgttattataaattttattttatctatattaattgtttatgtgggtattgtatatattaaaaagtatgaaaatttatatttatataattttgtaatcataaatcacaacatagataattttattaataatagtaattatttattagatataaaacataatagtacatataataaaataacttatatacctttatttaaatattctggatcaatagccattaacattatttcaaacataatagcaaaaataaatataccaaatatagaaaaagacataataacaactatattttatccaatgtatcaaaataaaactagtattttaactaatttatttatttcaattatattacaattatattgtattaattataataaattaattaaaaaagataatataaacaaaacaagaaaacaacacattataaatggatgtaatcctgaattacattggataacaacattattatttaatatgatattattttctatatcagtaataccaataatattatatatgttaaatattaaatcattttttgatttaattatattatattttatattgataattaatgcattatcatttatgcttttttcgattataatattaatgtttgataatcaatccgataaaataatattaattttagtatttatattaggcatactattacctatatataaaattaaatataaaaatattattttagatatattatcatatatatttatacctagttgtatatcaatgtctataattgaatatttaaatacacacaaactaaattatataatttcgattataatacaaattttattatatttaattttaattatattaatagaaagaggtttaattgatataatatataataagataattaatttaaaatataatagaaaaaataataattattttgaattacaaaatataaacaaatatactgactataattcatcattaattatgtcaaatgtttataaaatatataataataaattggcattaaataatataaattttaaaatatcagaaggaaaatgttttggaattattggtggtaacggatgtggaaaaagtactatttttaaaatattatctggcgaagaatgtgttacaaaaggaaatatttatataggatgttctaacagatcatggatattaaaatcaaattattttaaaaaaatatcttattgttctcaattttttggcatagatacatttttaacaggaagacaaaatttaaaattaattatgatattaaatggttttagtgataaacatatacaatattatattaatatttggttaaaattattaaatatagaaaaatatgcagataaagcagtttatacatacagtactggtattataaaacgtttaaaaatagcaatgtcattagcacctagatcaattttaactttaatggatgaaccaacgtcaggaatagatattgtatccaaacaaattatatggaaaactataaaatatattattaattataattattataattattacaaacattccattttaatttcatcaaataatatagaagaaatagaatatttgtgctctaatgtgattatcctagattctggaaatataatgtataacgatactttggaaaatattaaaaatatacatagtactaaaataattaatattaaattattacattatgataataacaaaatttgtaaaataaaaaataaattaaaaaataaaggttttatgttaaaatcagataataaatttaaattaacattttgtgtatctaaaaatattaatttgaaatatagtgaattatttaaaatattatatatattaaagaataattattcagatataattgatcaatatgatataagtgatacaaatatagaacaattattttcataaattattattatctatgtaaacaaaaaccaaaaactgctgaacaagctccactacaacattcataattattattacaattatgtccattttcagtacacatcataacatattcagatactaataataataaaaaagtaataatatttatactataattcatttataaaaaatatattaacaattaaaaatattttttttataatttttatatttaaattggaatacgataaaatataatgtattttatattatttatcttattatcatttactaatctatcttaaaataaaaatttaacttattatttaatatatagtattttatttaataatcttctaaataataagaaaataatataggaaaattattttttttaatatgtattattataatatcattaattaaacttaataaaatttttgatttattatcttcgttattgtttatttcattctttattataaaatatatccatatccacaatgatataggaaaatacgaatcatatgtataaaaattattatccattatatcatatatattgttaaatgtattaatttttatattaaaattataataatataattcgtcaatgatatatttattacaatatataaaaatattttttgtaataatttttaataataattgcaattcattatctaaaatatcataaatattatagttatattcttttgataataaacattttatatcatttaatctttcattatataatttatcttcaatatatgattcataatttttgtaatatttaattatcggtgttttaaaataaaatttaaattcaattactttatatgctagagaaaaatgttccatattattgtatttgtttgattctaaacatctttcaataaatttatgtgttggtatataatctaaaatttttattttattttcatcccataacatataatcataacttaaattaagatattttatagcatatgaatattctaaaggggttaaatattttgcaatcataaagtgtatttcagtaggtaaacggttaaaaatattattatttataatatatttttttttatttattttccataaatttctaaattccatttttataaaaataataattaatattttaaatatatatttttataattatattttataggtaacttactatttttccattttaaaatattttttatttcaacccataatataattttatttaaatcagattgtatattatttaatatatattttcttgttatggtttcgttattttgaatattatttattattttatctattttatcttttatattatttctatctattattatatttttatttaaattagtatatatatctttataatttaatatatcattatctaatttaaaaatatcatgattgtgtagaataatattaatacatttataataacattcttctgatatccatattgatatacctaataaaatatgttcgctaacatataatccatttaacgaactttctttattattattgattatagaaacatgatcattaatttcttttatttttaaatattttatagtataatcataattttcttccaaccatatgtgaatatttttttcataaatatcacataccctagatgcattatataaatttaattttttgttatatattaaattaaaatcatttatatgtaaacaccaataattattttttatattgtaatttatgatatgcgtattcattatataatatatatataaaatttcatattaaatttctaaatattttagattatcaatattgttaaaataaatttctagtttatgatttaatattatatttccgtaattaacatcaaaataccatatttttcctattttataatatactgtattatcataaaatggtaaaacagaaggtattgcatttatatatacatcacttaaattttctactttatgtatattatatttattgcaattattataaaaatctttattacatacacgaggtgttcccgttgtatataatataatttcttttttatttaaaatattaaaaatatcataagctgctattgataatattccgcctcctaaactatgacctaatgcaaatattttatttggtgataaagtcattaataaatttagtaatggcttttgtattttactatatatttcacaaaatcctttatgacatttcatatcacagttatctattttaacttgtgaaattctaagatcgtgttcaaattcattatatgttaatgttcctcttataacaatccataaattattatatctatctaatattaattttattattttttttttattataacttatataatatattttcatataatcaattgaatgtataataatgttatttgtaatttctgtattaaaatctaacaatattttaattaaatattttaaaacattaggattaaatttatctgtatataattcacttggataatttacattatctatatttatttcaatgggaatattttcatttaatatttcgtatattcttcttttaatatataaaaccacatataaaaatattataaacataaaagctaataaaacaattatccatattaatatttcaaatattgtcatttattatttattatatgttagtaaataaaataaataatttatatatctactgtttctatatcatcgtcttctatattatttctagcacatatttgttggattattatttttttacattgataataatctattatatattctctaaacaaataattactatcaattattattttttttaaattttcatgagaaatttgtaaaaataaaggataattatcacaatcaagatattctattatttcaatcgaaaaagggaacatatataaaattctatttataatatttttattattaatattataatttattttaatgtgttttatatttgttgaacttaaatcaataataatattattaaattcataatttatttcatcttcaacatgcatattattaatttcaaatttatataaattttttaatttttttatataattaatatttttcaataaacatatatctgatattataatatgatttatagtatctggcatatttattttgttaatattgtattcgttgtgtgtatctaatattaatttttttaaattttttaaattatttaaacatttgaaattgtatgacgaaagactatattttgttgaaataaataatattgtttcgactgaataatttttttgtgtaaataaatattcaacaacacattcgtctaatattattttttttaattgcaaatcagatatataataataattatttatatttttattgtttttaatatgaataaattctaaagataatggtaattgaatttctatatcattattattcatattaaaatcaattattaatttttgtaacgatgtattttttaaataaatatttgaatcaattattatatctgttaaatctaaaaattttaaatttttgaaaatatttagattaataattgacaatttttcaggataattaatattaactgaacaattccatttttctaaatttgaaaattgttggattttatatattatattttcaatgttcgaattataaatatctaaatattctatagtttttggtattccatctaacgatgctatataactattattgtatgatatatttaatctttttaaattagtaaatttttctaaaaattcataattattaatatttatacattccattattaattcttcgattgtttcagataaataatcagataaattatttatcgaattatgcgatatatttaatttttttaaattttttaatctttcgataaattcataattttcgatagaacatatagaacaatctaacacttcgatagtttttggtaataatatttccattatattacaaaactcattatttgaaatattcaaattaatcaaattttctaaataatgtaaaaaatttacattatctatatctaaatctgaaatatttaatatttttatacattttggtatatgatataatatattattattattatgtaatatatgcaattcttctaaattttgtaaatcttttaaaatttcataatctataatatcttcacatttatctatgtataattttttaattatatcatattttataatatgttgtactttagaaaatactattttttcatctgttaaattatttaaatattcttgagcttcttctttattcattttgaaaagtaatattgaatattatgttatattttttcatttcacaaaaataaatttatttacaagatgaataaacaaaagtataaactttaaataacgacattatttttttaatatcatcattgttatatatatttttatcatttttaatatcattataaaactttttagttgattttcttaaaaaattagataaaacttctacagatttatcagaattatatttaaatatatcatcaaatttacaaacatctgataatataaaattatacatagcaaaatcatcaattattttatctgttattatatattcttctaaccattcagtcattgtagcattatataaaactgatattttatcatctgaaattttagaaattttatatgtaattccgggttgaatattataaattaaattaggattttcatttaatctatttgttatttcgtctccgtcaagacaagttattattacttttgttccatcgtttgataaattttttagttttaataatatcatatcttttgtattgttattgtaagaataatgaatagctaattgccactctataactccaaaatattgtattttgtgatgtgtcataaatttattttttatttcattttcataattatcatttaatatagacatgttcaaactatcaaatttatatatactagcttgggcatttgatatagtttgtaattttttatatctatctcttgcttcttttatagcaaaaatatcaggatctgttcctaacattcctgttattccgacataataatatttagttaaatctcctcctcttcctatatctatacttaaaacatatctatttggtaaagttgttactaattttgatatagccatcgatataccattagtttttaaataatttgttaatatatttatagatgttctaatagtattattcataaaatatttattaacttctttatttaataataatttggatctgtgtggattattatctattacatttatagtttcatttaaagacattaaataatcaatattataatttgatggaaattcttcgtgaatgtgtttggatgttaatataacatctagattattgccattataattttgtctatagaaattattagttttatcgattcttaatccaataattttagattctaaaaatgaatattctacaatacaccatatgggcgataacatttttttaggaccaaatttattattattattaaaaattaataagttaacataattattatattctataatttcgttcttttcttcgtattttaaaatttctgtaaaatttttattatcatattgatataatgtaaaagttatatataatttattatcattgtgtaatatatatgttcctctataagtgtccaatttacatataacatctacagtattatctattttaaatttataatcttttttagaatcattatctgtaatatctagtaatacaataccatcgtatatatttttaaatgaactattttctattgatttataaaattttagtacatttgtagttacgttattttcgtcaaattttaaagttaatttgttttcaaatttaatttgcatatttggtttatgacacaataaattatcattataatattgtatttgcttatatctatctagaatattatttattatttttttattattataagataattttgaaaaataaaatggatatatttttttaacattatctaccttaatgtattctcccatacctatcatttgtatatttttatctatgttacatgaaaaatttttatataccatatcatatattatgatattacaaattccattcataacattaaattctacaacatctccatcaattttaatagccataatatatgattctttatcaattgtatttaatttattatattgtatcatatgtgtttttattttaggtttattttttattgtaactaaacttatattagatatatttttgcttttatatatatattcaaaagattttactaaattatcataaagtacattattatccaattttgttttagatagtacttctatttctaaataatatgttatattttttctatatgtttctatatcattgaaatgtgtacttaataataatttatttgacgataatggtccaatgtttgattttattttaaattcaacttttattaaatcatttataattatatataattgcgaaacaaataatacatttattttatccaatatatcatttaataacggtaattctatatcattatcttgatattcagtattatgtctcaataaaatatattcatttttattaatatttattttatcttctgatattatagtttttctttcccaattattagtaagtttatctaaaaaatatgaatttgctatttcaaaagtaggataatcatatttatatttttgtcttaatttagactttttgttagcaaatttaagtacatattctaaatatgttttttttttagattcattattatcagtataaatattagataaaattcttaaatctggatttatgtatgtaaattctatttcattattaacatttggattactatcaaaattaatattactataaaattttatacaatcattaataatatcagaaacgtcgatagacattatatttataataaatgatatttatttatatattattattttttttaataatatttatttttatgtatataattgtaataatttattattataatatttcatatttaccagaatttataccagatcaaataataagacaaaatgaaggtttggctgacatatcacattttataagaataagagaagatattaatagatatatattagatataaatacattagatgctaatataattaatataaagcaagaaattaatagattagaaaatactatcgaaattcaacaattgactataagaacattaagagatgaattgcgtaaaattgaagaagctatcgacgatcaaataaatttagaaataggacaagtagatttaccaagtatattaatgcccttgtatattttattagaaacagacacatatataaaatattatatttataaaaatgtattacaatttacatataaatttatttatttaacacagttgaatataagaaaaaacacaaatgtaacaaaaactactttactattaaataatttaaatttaacaaatatatatgtaaataaaataaatacttatatgtatgataaaatatctatcgatatatataaatttatacagttattaaatttatataattccattagaaatgtttagaaattaacataattaccaattattttatatataatttgtaataatatatctataaatggatactcaggaacagatatattattactaataaaatttttagtagctttgcattttgtttcgatataatcttctgttatttcttttgatatgtcgataaaaatatttaaatttaaagtactaactagaattttttcgatacctgaaaaaattaatcttataactgtattactaatatcataagaatttttttttattttaatagtttcgataatatcatacatttcttcaatttcttttatatccaagatttcaaaatctattaatggtagtgatattcctaaggttttggcataattgataattacatactttttattaataagttcattaccacacatatttaattttttcattaattcgtttaaattttctgacttttccatagattttacttttttttttaattcagaattttcattatttaatttttttattatttcagtttttgataaatctttaattgtatcctgatttggttctataacattaattacattctttaatttttcattaacgttattattttcaataatattaatttctggcatataatcagtaaaatatgaggatttttttgacggaatgatattatgatcctcgattgatatttttatttcattattattaacactatcatctattaatatattattttccatacattcttcttcatataatttacttattcctatgtcattattaatactactacaattacttattaaatcttcttgacattcttcaacaatagaaaattcatcgttatttaaataattatataacattttataattttcaatctttgtaggaaataaatgtttttgtatttttccgggataattttcattattatatatatctattacattattatcttcaactaattttgatacatgcatttatttagttttttttttatttaaatgagaaataataaagaaaagtatatgaatcattttacggattttataattcgtaatttaccatttagaaatttaattgattcgatgaaagaaaatattattattaataatgaaacatataaaatagaagaattatttaaatatatttattatcatccactagatttattaacaattagagacattagtaatgcagatagaaaagatgaatatgttaaacaatttgtaaataatttatatcttagatatgcatataacgaaatggattttataaaaaataatataagatatgacgataaagtatattctattataaacgaaattaattattttccagaacatacttcggaatttttaaaatatagattatcacactatgaatcagaatcaagaatcagaggaggaagagtagtaacttttagcggtgttcctgataatggttatggttatttattaagtcaatcagacccttcatctaagtatatatgggcaatagtagataactatttaatgattgataatgaagataaatttgatttttatacccaatatattccatttattaattattttctaaaattatattataataacatcacaaaaaaatatattattttagatcctagtaatcctgaagaaaataaagatgtacctaacgctaatttaatcgacgaaagtttaaaaaataaatataataattttacaaagaaattatcatattttgatatatcaaatagtagatataattctataaatgatgtgggtgattttaataattatttagatatcaatactaataaaaatattattgaaaattatgatgtaattattaataatattataaaatcaatatatctatataacataatggatacaaatgtagaagatatattaaatataataatgaacgatacaaattatttattattgaatgaaatatatagtgaatatttaccaaactcaagcaaattatatgttttagtgggattacgtcgcattatatatgaaaaaagcaaacaaaataaaaatattagcaatttatatatgttagattcatttgtaagtatattattatatttattagaaagatattacgaaaatgatataaccacacttaatgaatctaaaagattaataaaacaatattataaagataatttaaattcaaaaaatagcgttaatttggattctataaatattattaaagaaaatatcaataataatattattaatataacattagatgaagatgaacaatcaagatataatttaataatagccacaaacccagaaataatagtaaattatgcaagtagaaattattttaacatcagtagtaacgaagataacacatcaaatgtgtataaaaaagcaatggcatttttcataaataattttattgaaaataatataactaacgaaaatataataaataatttatcacaagtttatactcaaaatacagattttattaatattacttatgatgatctaaataatttaaaaataaaatatattaataattataatataaatttagatattaaaaaaattattaatgacaatctagaaataattagaatttataaagataatgttttatatgacactaatattaaaatgaattataaatcatttatatcactattacccaccatatactatattattttttataatcaacctataaatagaaaaatatatagaaaagctataattcaagaacctccaattgaagaagagatctcaactgaaactacaaaaagagctagaagagtgagatttaatccatttaatgtcgaagaaacaataatagaacccaagagtgtttttgttaataaaagtaaaaattatttatatgatacattattttggtctggcatatctatagatgattttaataaatttccattatacattaaaactattatcttggatagttgtcttattttaggaagacaaataaacgatgatgggtcatctacttgcgttttatatcatgatattaataataacgatgttacaaaaatatgtataataccttatccttatacagcaaacagaactatgtatgatgtttttaaacaagtttcagataaattaagatctatgtactcatatcctgtaaattataatataaataataatgaaaaacatttaaatttatcaaaaaaaggaaattataaatttatgaataaactagcagaatgtaaagatattaaagatttaatacaattttatgttatggtaagagatacagatccaggtcattctgaaatatcaataccaccaaaccaagaattatatttagcaataactttattagatttattgggattttctcctactttatcaagaagaaatactagtattggtttttcatattacattcaaacagatagacaagtatctgctcgtaatttgatatatatattatcaagaaactacccagatatggtaaaaagtaaggaattatcagatgtagtaattaatatattgtcgccaatacttgcatatttaagatatgtattaaattattatagaacaaataatacaacattaacagctggatctaataatgcaggtcatgattgttgtattcctattaaatcaaatcctttagatttacttattaatatagatacatcttttactgattccgacaatatattagatataatgaatagagatatgtttaatttggataatgatatatttagacaagtaatacaaaataatatttatagcgctggtagcgttgatattgtcgatattataactgataatattccccaaaacatttatatgaaaacaaacataattgataaaatgtatgataaaatttttgctggtgaaagtattagcgatatattggatatacagtttgatgaagatattaatgataattttaattacaatgatgtaaatatgattactaatgatttaatgaaaaaactaagaaaattattaaaaaaaacaactattaataatttagaagacaatgctatgatattaaagtcacaaatgttatcatctattaataatgtttttaatcgttattcttgtatggaaaaaataccaacacaatatcttataaatattagaacattattaaaacaatatagtaatgaaaatataaaaattgacgaagatttaaaaaataatatccaaacaataattagtaatatccatagtaatactaaagatataattaaaattattaccactttaagtgctggtattgatttagttagagcattaaaaagatctaatgcaaatgtagaaaataaaacaataaatcttgaatttctaaaaaaattatgtgatatttgtaaagatagtttttataaatataatagaaataatgatatagtatataaaaatttactaaaagatgtatttaataatgataatgaaattaataatgatagtgtgtttgatacatgttaataaaattatttattattatcagatttttcttttaaatcttttttaactaaatcgtttaatttattaatataaacactcggagatatttcatcttcgtaatttgattgttcttcatctacattttcttttttaggattaggaaattcggcgactaattttacaaaccaagatatcttagttcttaaaatatttttagcatctcttctaaatgttattttattaggcaatactaatccattaactttaaatgtttttataaattttttaacatcttcgtccatatctttaaaattattaaagattgtgtctatgttaatcaaacatttagtatctccgcaaataaaattaatagtagaatatttatttctctttaaatatattttaaaatctccgttaacataatcatgatttatagatgtgtctgaatgtttactaataccgctatatacttcatcaaatggtttaaatgtttcaccatcatcagtataaacagacaaatttaatttattatgcacacattcgataactttatctaaattatgatgattttttaccgacacacatacatagttatcataaccataattttttttacttttatctaaagccattataagcacatttccaccaattcttgatggaactaatgcatattgttgatgttcgacattaacaacaaaagtacaataattatttgaaaacttacatttatttaatttaagaagatttcctatagaatgatcaatacaattattagtattacacacaatacaatgaacgcatgttttaatatcgtcacatattttacaatccattcttttttccatttcacttaatatttctataatatgattgaatatggttttaggtgaaatatctttttgttcagatagttttagttcagacattttttgttcagtaatttgttgttcagtcatttttatattaattatttaataattatttattattaatattaatatttcaaaaatataaaattattaatgtttgtataatatttttattttttattattttatttcaaaaattataattatatactaataaataatgacaagcggattaatagtaggttcaataatcaccggagtgttaatattatatgttggtgttttaataggtattatttggttatctattatgccatattatcaagtagaaagttttgatattaactctccaggatattctaaaattacaataccaccacagcaattagaaaaacaattaataatggaaaaaccacaagaaaatataattaataatgattatgatcctttaatatattcaactaaacatattcaaaataacgatagtaacttaaattgtaacaataatataatagtaaagaataaaaaaaatagaatcaaaatgaattgtgacgaatttaatgaattatattgtaaatcatcgttaaattgtaataatacttgttgtgatgatactaatttatatatttcaatacattatactgatagattaccattaaaacacgcagttcataatataaatttagctaatatgaaaaaaacagacattctatttataaataatgctaatattaaacacgaaaataaaattattgattatcgtgaagataaatcattaaattttccaagaattaatattgataatgataatttacacacacaatcagaattatctggatattatacatattcttcgtatatagaatcagattgttctcagatgtttattggtgttagcacagattctatatttatgtcagatccttctgctagatcagaaatatatgataaaaaaactgattatgatggatattttatttctataccagttagaatagtttctggtcaatttgctggaaacaaattaagattaataaacatttataaaatgtatgatccaatatataaatatgttagtatagaaacatttaaaataatacaatatattttcgattttatatataatgaattctctgacgatattttaataattggtggatatttcggtttaaggaacgaattaatacaattagctatgaataaatcgaaattaaatgaaaaactatcattatttccatacaataacatgtcaactgtaaataattttgaaggatgtagtaacccagatgctatattgatagataaaaaattaataaataattgtaaagttaaagttataactaacgatccgtggttttatgataataataatcattatatattaactgttatattagaaaattttaaagataaaaattatgaaaattctaaagaagtcgctagagcaaattggaatagattacataataaaaataatagtatatatccaccacaatatgaaatacctattgattatgtaaatgtagaatcagatgaatataatataagaaataatcctgctaaaataattactgaatagtatttataaatatagaattataagatggtggtttattttttttaattattttattttgtcttatgattatattttctagtgctgacattttgatttctgttaatattcccagatatacaaatgtaccaaaaacaatacaaattactgataaacatataataatatcgtaatttaaatattttttaatagatattgaaacataaaataataatataaatcctactgtaatcataaataatgatatagatatactcataataatatataaatttttaaatttattattaacataatcattgatttcattttcataatcttgtaaatttttatttttttttaatatagaatataacattttaaataatatattattaatatttatatattttttcaaaaaaaatttaaatagtttcataatcaggtggaggtaaatttatagatttaactaatttattttgatctattatcaaattaactaacgcaactaaatatatatttattattgatataataaatattaatattacaattaatataacaacataaaatatagttaaaattattaatacattttttattatattaacatacttaaaaactaatattaatattaatgatattaatataaacaatactaaaaatatatatattatgcaatgaaaagagttggattgtttgtttacatattgttttatattaatattgtgtttatttatttttctaaacacatcaataaatatataatccataattatataatctaaatatctattttttttcaaaaaaaattatatgggtttacatcttctataatcatcagatgttaatatattcatgtcacttcttttatatgatattatttttaattctttcatatacactggatgatataaaattttatattcaattaatgatgaatcagctgatggttttaaattttctatacctacattatctgatacatgacttattgttttattgtcttgttttaccattgttggataatgaatacacaataattcattattaaatacattaataatttttttatattgtgataaaatattatcaagcattattataggttctggataaacatcagattcgttgatattgaaattatttttaatatttttatatatataatatattattttagtattttttatctctgtagttaatataatattatcagttttttcatctatggtatctttaacatatttatatgaatctccatcaaaatatatataattttctttattctcatattgattaataacatatgtttttgttttaagtatatcaattaaattaattaaatttgatttcatttaaaaatatatatttttttttcataaattataaaatatagagtaaatttttttttataaatgaatgtttttgaaatggatagtataaatatatctaatcgtaattatttaatagcaggtgtaacatctgataatatttgtaattgtgttaatgatagtgctatggatgattatttatttgatacattatctgtagatagattagatggcggatatataaaacacgaatgtggtatagaatgtgggtgttttaatggtaaattaatggctagtatggcgacagaaatgtcaagagataatttaatagcatcgtgttctaaaagtgcaggagcttctaatgtaaaatcatctaataatcaaaatcaaaaaaaaagaaaatcagaatctggtaataaaattcaaaaacaattagatattatgaacacaaaagaagatcatattaagaaaattgctgaatatgtagctaataatttaccaaaatcacctttaacatatacagttcacgacattaatagattaattatcacatctccttttaaggatgttattttaaacgaaaatgatatgaaatctataatcggattggctgcagctttttataaaaataaaacaataaatcattcattattatcaactattaatattaatacaaatgatcttattcaacaattaagacaagtatataatttatcaacattagtagattatgattcatttttaaataatttaaaagtagccagtgtggaatatactgatattgcagattgtaatgattacattaaatatgtgccagacgaacctaatgttccatcaatattatttgctttattttctacaagaatacctgtattatttgatattgttgtaaatcaagatttatttaaattacaacaagagttacagacagatgattatagcgcatataaaaatatatatctattgctttttagattatctgatagagaaccatactattcaaatcaatctggaggacttagtaataaaattgatgtttatactgaattaagtcgtatattattatctatgtcgattaaaagattaatattaaaaattattaaaggcacagttacaggaaacacagtagctcctataatgaatatatttaaaaatttatatattaaaaatgtcagatcttctcaagaagctttattatcagcaattttaaaaatatggtcatatgctccaacaattgttctgaaaaatatatcatctgattttagaacagaaactgtattttttgttgaatatgaaatatctgaatacaatcaatttgaaaatcaaaatataaaattcactcaagaattaatgaaatatatttattacgatcctattgttaataaagttattttgtctcctaaatatattttggattcgataggcggaaacacaggtatgcaaagtataacatattgtaatagtggttttagaagtattaatcctatgacaaatgtagctttaaaatcaacaggtatgttcattttatctatacctagattaattaaacaatcatattcttatggtttacctgacgaattttctgatagattattaactaaatatgtagatttagatcaaaatattaccattggttgtaatatgtttcaattaagagcggccgtttgttacaaaatatcaaaatatgttgatttagatacatgtatacagaatcctatatcattaggaacagttgctattgtaaaaacacaaaaagggtggattagatataatccagatttaatgtattcttgtaacgaaaagaaagatttattagataaaatactaagaaatgaatataaaaaatcattgaatttaaataattatgaagttaatcaatatttagataaagattacgaagaatggaaaagtactttttcatctattaataatattatcgataaatttgaaaaaggttacgtaagtacagattcattaattattcaagaggcagaagccatcgatataattagtagatatggaactattataatatacgcacaagaatatactaatggtgtagatatgttaccactgagaagatattattaaatatctacattattgataatggaatttgtttcagataatttgtaataataacttcttattataactaagaaatatatattaaataatataatagcaataaataatacaattccagtatataaaatataatataaataaaatagtaaatttaaaatatatattaatgttaaaacgtaagaatatattatataatattttataaaattagtatttcttttatatattccaattaatagtaaaatatttataaatatagatataattgaactaataatctctattgtaacaatattatataatataaccaattcatcgtgtttaaaatcataactatttattctatctatagttataccaaatataattatatttaatatattccataatatatttatataacctattataatagatccttgttttaaatctataaactcaaaacaattatttacaataaaataaggcatttttatattatatcaataattttatattattttttcaatttcttttaattatacatttatatcatttaatatatattcttcgttattttgatttgaataattgtctattataaataaattattatatttaaatataattgttataaaatatatatctaatattatagcaattatataatttaatatatcaatatatatatcattatatgcgtataatattataattattatattaattattatcgaaatatataatataatatatatttttatatatttgttattataatacattattataaataataatactataattattatattattaattaatgaatttattattgctaacaatgtaataatttctattttacatattatagataaatatagtaatccagatactataatagcagttttccatataaaatttaaaaaacatacaattattaatgataattttagatccataatatacattgatgttatattattttttcatattgaaatttattattttatattaataaaataatataaattacaatcataagaaattaatttagtatatgagatttaatcacggaatcagtataaaatacatatttatcttcattttttatattttctaaatcatcgtctgatattaaacaagaataagatacagaatcatatattatacaatatatataatattttgattgttcgcgatctttaaaaatatttatcacagatgcaagtaatgaatttcttagatttttattacaaggtattaaatccatattttctgattcggaatttataacatgatatgataaactatctcttgtagttgtatctaaatgttctaatctatgaactagaaaaatatttgatactaacgaatgtctgcacacatttgtaaaattacttaatttatcttttgtgtctttgccaatatcatcataaataactaatgttctaaaattttcacacttttgattcatttcaaaactaaaatttttaattttttctaaatatgcttgtaataaatatttaacatccttgtctttgttattcgaataaagataaaaaacatgattgggataaataaatttaaaatattcatttgatttaaagttaacttcagaactagtaattaaatatataaatttataaaatccgtaaccaatttttaataataaattctttaaaaatgtagttttacctgatcctgtttttcctataattgccatattaaatggtttagcacgcagtttatcataatcgaattcggacatatttataataatcaatttttataaaattatttttatataaatgacagatactacaactgacgtggttgctatgaaattagccaatgatatcatgaatatgccatcttatgtcaaagttgtaaaagtaaataatggaagaatgggaggtagaggaagagaattattagcccttttaaatacatctcaattagacggttttatgaatgcttttagaggaattactggaatgtttggtaatactggtggtttgcatgaatcactaatcggatcattaaataaaggttattataatgaaatggaagctggtgctgtagatggtggatatggtccacaaggtaaaaatctaccctctaataatccaaatagacaaagatatgaacaatatggtagatcttataatcaaggaaatcaaagtagccaaggtaaccaaagtagatatgatagatatgacggtaatagtaatagatattataataatgatagtaatgattatgataataatgatacgtatggacaaggacctggctgtactcctaatgtagacggtagtcgagacagaagatgtagagaacctaatatgggtaataatagtagtaataatagtaattatcaaaatcaaggaggatcacaacctaatgttggagaaaaactaaatgtagataaatcattgttaagtagtattttgacacgttgaaaatttaataatcaatataaataaattttatattacattgccattatatataaatgagtaatattgaaatatatgatatgtttgaaggtgataaggaagtactatttatagctggttcacatataaatgaattaaaagctgataaaaatttatgtagtgaagttataaataatgttgttaatgatttttcgttttctaacattgaaaaaaactttaaaaatataaaaaaaattaataaatttaaatataaaattattaatgatattacaaatgtaactgaaacagattattttaaaccatattttaaaatgaaaccatatatggctaatcaatatatatatcatatacatactggaggatatggcatgactgttcgtattaatgaaagtttttgttttaaaatatcattaaatccaactaataatcagatacatgaatttgtaatacccaggatgttatctagtattatatcttattcaaacgcagacaaattaatattattaccatatacattaataaagaatataaatttcaatggattgatatatataataagtatgcataatataattttattattaattaattttatattagataaaaattatagtaatattgatatatataatacatatttagattttaataaaatgaatagtatttatagatctttaacaaaagatgaagaattattatataaatgttttacttatttttataaaaaatattttaaaaatatttttaatgttataatgattaataattattcatcaataatttattatttaagtactattaaagatttattaactaataaagattataaagacaaaatatatggatctattataataatgcctttagctatatgtgcgtcgaatgagttgaaactttcaatatataatgacacatatgttccagatatgataaatggaaatattgcatatgaagtaaataatagatatataagacatattgtattagttgttttattattaatatgtataccaaacaaagatagaatgatattttttcacaatgatataaaacccaataatatattagtttttcctaatgtaaataaagaaaaattaataataaaatataacaataggaatataatatttaaagaattatatatattaaaattaacagattttgatttatctagaatagaaggattagataacaatagaattaaaaattctccaatattattatataataacataattaacgatatatattattttttttatagattaaaatatgatttttttttaaatttaaaaacaatagatccagagttaaacgaacatatagaaaataaatttttattaaaaaaatatatgaaagatactataaataatcataattacaaaggaaatgaaaaaatgtctataagttttgttaatgatttcatatttaattctggattatttaattattggttagattaaatttattttttatattattatttattataatatgtttgtcaatcatataattaatattttcttttatactattatcattatatataaaatatttaatatgttcttcaaatattttatttttaaagttgagtaaatatttataatattttttatcaataacagacaattctaaataattaatacaatataatttatctatatttatatagtcatttacattattattataatgtatataaaatatatttttatcatataaaaaatttttattataacacttatataaaaataatgtatgtatataatctaataatatattatgagatagattaattaaattacattttgtgtcatttattaataaatcataagatgattctatataatcataaattacgttatattttataatatttgtaattatttttttaataaaatataatactatatcatttgtattattattgttatttaaaataattctaaattttaacattaaatatccatatttaacatatcttttaaataaactaaataaaacattttttttattataatttaaaatatttatatatttttttattgatatataataagaaatatcttccgttttatatgtatatatattttttataatatcatttatactattcgaattattgtcatattcaaacaatatttttttatatgaattatttaatattttaatattgaatgtattattgattttattaatatatttatttaaaaaatcattatatattacatttaatattgggtttttatattcttgaacaaatccagcttgtctaagtggatttcttttcttttcatacatattattatattttattaaattagcaacatctacattagtagatttactttttttagaaacgttagttttcggaactgaaaatgtattaattctaggagcattttccaaagaatttatatatattataatcttatttaatgtttctgcataacctcttaaggtattttctgtttcagttatatattttggtatatttccttgactataatttttatatataaaatcatttatttcttttagattattttttatcgtatctataacattaataaaatcataatttatattatccaacacattttctattttttcttctaattgtaaataattcatattatcaatttttgttaatatttcattatatttattagatattatattaatttcatcatatattcctgctatgttttcattttttgattctaataaaggtaacaataattcattaattgcatttattttttcatcaaattctgacgatatttctgtttttgttttagataataattccttaatttcatctaattgatttaattttaataaatcgattgattttaatattttatcatccaaactatcaaaatttgataattcttctatatttattttattatcagataatattttatctaaaatatttattattatattttttatttgcaaacttgctcttgaagtataactttttatatattctttaatatttgcgtatttagattgtaacaaaacaggatttatttctaaatattttaatattttatctatttttgctttttcgtcattaaaatcctcgataggtatagttttaatattttcgctaatattattttttattttttcgatatcagcggcaatttcagatattttagcattattagtgctaatatctgtattaattaaacttatactattgtttatatcataaaatttatcatcaatataattttttaatctagattctacctttgtaattatactattttcagtaggaatattagattttataatatttaatatataatctgtatttatattattaataacactttcattaataatatttttaaatttatcagagtttacatattctccgtttaaaaaattttttattaattctggtaatattttatttataaaaattttaatatcttctgataaatcaatattttttatatctatcaaatttgttacatcaccactatttaaattttctattatattgttaaatttaattagtaaatcatcattagttaattttatatttttagatatatcttcgacgtagttataaaaataactttctttatcgtttattttatttataatagcactctgattttttataaaattatcatatttttcatcaatcgaattactaacatcagataattgtcgaaatctagaatttacattttgtttataatgatcgtgtagtttttcagtttcctgatatagatttaatatttgtttatcatatttatcatatatagattcaatcatagtatctatatcattcatataagttctaagattttgatatggagatattaaaacatctaaagatgatagatgtgtattaatttcatcttgtttaatatttatatcatctattttttcatcaatagattttttatattgtttataatcattaaaattattaactaaatccattatatcatttccttttaaaaattccttatttataatttcttttaaaatatttttaaatttttcattaatatttaaactattaattagagaatctatatctatattttcactgctaataatatctttaattttttttaaaaaattttcatttgataatattaaattagataagtattcatcgtctgatattttttgttttaatttttttataacatcgctatttttttctacataatccattataatatctatattttttgatttaattatttccatatcaattatatttttatattcatccgatgataatatattattaatataatcattatttattatattctttaaaaaaataataaaatcttcattatttttaaataaatttataaaatcgtaatttttattataattattaataaaatataaaaaatcatcattagttactattttattaataatattattaatttttatattttcatttatatattctttaatattatttaaaaataatggatttttagatataatatttactaatttatcatctgatatataatttttaatataattagttaatttatcaataaattctttattttttattataatatcaatgggtattctggaaattaattgatcaataatattattgtcatttttaataatatcatgtatataattttttatatttatattaaattcttgatctgatcttaaactatatatcaaatcttgtacatttatattattattgaaattttttctaatagattctaatacaatattttcaatatttaaatttatatatctattaatatatacattatttataacttctggtaattcgaatactctattttttaaaatattattttctccatctttcatatgtaatataatattagaataaaatgtcaaatatgtatataaaataatataatcttcgttaaaatatttaatattattcatttttaaaaataattttaatacatgtttatatttttttatcatatcatttgtaaccacatcactagtattgaattcataaattatatattctatttcgcttaaaattttagttattaatatatcattactatatttaatataaaggacatcaatacattcatcaatatttgaaacacttatgtttttattcatccgatttatatatgtttgattcattatttatatatacacaattataaaaaatatctatattttaagtaaatataaataatggaagatctatatattaatgattcattgtcacaaaatatatcagcttttggtaacacaaccgaagctggaaaaaaatattatgtaatgccttcaaacaatccttatgttccaactaatgccatgttaaatcctattactgatcctatatataaaaataataataataataataataataatgtatcagtcgataataatataacacaagatatgaatgttagtgtagatactaataatgaatccagagaagcagatatttctatttttgctaatttagaaaataatgttccggatttctttgttaataatataagtgaagaagtttttataatatttattgctacagcagcattattagctagtgctagaataaataataaattaatttcgtttatattatttgtaattatatcgctgttagtatcattagaatatggtgttagtattgccattgtattctatgctatattctttgtagatacaatggacatatttattatcattttagtagtattagctctgattcatatattcttacctattcctggattagttagcgatacgtttaattggaattatgtcatacaagccgtattaggattgttattattattatctattaataataattggaaaagagttttttgtatagataatagtttaaaaaatagtaatacaaaaatattcaaagacgagaatacaaatggaatattgactaatatgtcatattaaatttttattattgactagaaaattgtaatataagtacacaaatatgaaaaaatattaaagctataattaatataattaatggcatacacattattaaaattatataagtatattttttattatttacaataggcttattattaagtaaaatagacccatttatatatatcatattgtttaatatagatttttttaattttagattttcaaatctagttctctttgttaaatatttaatgaatggaattatataatcatattttatatataatcctgatttatatcttatatcaaaactataattattataattaattaaagctatgttattagtagataatttgtattcatttgttaaattaaataattttattgttttattatatatattataaattgctgaattctttataaaataaataatattattataacagaatataggatattttgcaataaaatttttattaacataactaatattattatcacttataatactgttattatatttttttaaacaacatatactttctttatctatacatgttaatatatttataacatttgtgtcattacaaatatatttattattaaattttaattttatacaattactattagtaattattaaaatatatatcaatattatatttatatacatttttatgaaatcataattttatcatatatatttaatttttttattttactttttcttatataatatatacttaataatgttattattaataataatattataataattattatcaatatatatattgtatattttttattataatcattaatatattttagaaataattcaggatttaatatataattattattgcatttaaataatctttcatcaattacaatattatttatacagttattataaatatcatcattcatatatacatattccttaacacttaatatttttttttttattaaaaataaatataatatattatattctattgaataaacaaacaaacaagatttattattaaaacatttatgtttataatatattattctattattagttatgtttttatattgtgaaatatttatactattaattattttatattcattatcacattctattattaaattattataatgtttcaataatatattactatcagaattaattaaatttatatcttctttatattctatattatttaaatataaacataattctatgtctgtatgagcaaatatttctgctattattaaaaatataattatatatccaaacatattgatatccatataagtaataaaatttcatagatattttttatttactccacgtagatttaacataatctgctatactaaatacaattaaacctataattaaaaataaaacacatgcaaccaacgattgtatatatataaaatatttatatataaaattattataagaatatttatatgaaaaatatccacctattccagtttttacaatttcgattaaatatgacacagaagcaaaaaaacattgcgatgctaatatatctaatactattgtaaatataagcatttattatactatattatttgaatagattcaattataatattatttatatttatatttaaccactttaaaccgatacatgtagcatcagctatatcatcatattttgtatattcagataaaatagaagtgtttgtattttttattaaatttttaaaaatattaatagtgtgtaattttcttagtttgtatgatttaatgtttaaattaaatgtatatggtttcgtactttgaactgatatttttttactttcgaaaaatgaatatatatatccataataaaaaatattttttcttcctctaaattgttgttcgataattaccttatcaacattatatatacaatatttattatatatattatttaatttattatataatttacatgatgttaaagggggtaaattttcttttatacatattatattacatttattatctattaaacttatcattgataatcctaaattttttacaccaatatcaatagataatattatcataattatttatatatataagacataatcaatataattataaaaccaaacatagaacatatatcaataatataatatagtaaatttaaaaatgatattattacagtatttattacccaaataaatctagtaaaagtaaaaaatataattagagtattaaaacattttattatatgtaataattttttcatatatatattatcgttttgataattcattattaacgtaggtaataaagtatattcgcttaaataatccatcaaaatttcatttaaatattccatttttaatattaattatttttcattaattagtaattataatatcttcttcagtttgattaactatagttgttcgttgttgtggatcaatattaaccatttgttgttgttgttctttaattattgtttggtgtgtagtattattattacatacattatttgctaaaaacattgtattattttcaggtgtaaaataactaaagtaaaatatagtattatatagaagccaaataacaaaaattaaccataaccattttgcataattattaatattaaatgttaaatataatataattaatgatataaaagtagcaaaaatatataatacacctgaggctaacaatgattgtgtttgatatgttataggatttgaaatatatattaaaaagaataaaacaggtatcatataaaataaatatataaataattgttctcttctactttttatattagcaacaaaaccttcattgtaatattgatatattaaaactaatgcacctcctgcaattagataaaagaatgttgaaatatataatccatatggtccatgagagatatcaggtaacgtaaatctaatattagaataccataattctgaacttgatgaagtatatatattactagaaattagtccgattagtggtaaaataaaaataattattgcaaatgataattgtgaagttattaaatttttaatagtatctacgatattcgattgtcctgcagtattgtccatttatatagaaaatattaacacatcgataaaaattttatttatttaaaaaaatattacaatctgatataagcacatatataaaaatatattgtatgtaataatttattatgttatctattatgattagattaaatattttatataattatacaatataatcacatacattttgtttcatatgcaatatattataattaaatagtgtattaattataattattatattttttacaaaagaccatattaaatttataattacgattaatattataactgttgttaaaattttagaacaacgttcgtttgtatcaaagatttcaatactgaataccatcgaagataatataattataaataattgtatagatataatacaaataataattatttttctaattatacaacgtggttttctttttaatattattataatacttaatattgtatatactaaatatgttccacatattaacgaattaatataatcaattttaaaagattcgcatgcatccgatatcacaattaatggaagaattatacaatttattataaacatacatatagttatcataaaatcatagttattataaaatttagttattttttttttatatattaaatcttgatctggcgtaggtggtaattttcgattttgtgtatttttatatgtgtatgtatttgtgtttgtgtttgtatttgtatctataattgtttccgtttttgtatctatatttacttccgtttttatatctgcgtttgtagaatttacgtttgacatttcaattttatttaaatcattgtgttttggtttatctacatcaataatatcttttttctgtctaaaaacatcagaaaatgtgattttatcaatttccataacaactgttgatttttcgtctttttctattaatggagataatgtatctttttctattttatattttgattttggttttggtttattattttttgaattagatatgggtgttttaattataatatcattattatttttagttttattggtatttgtaacattatttgtgtcatgatttacaattgcatttgtgataggatttttatttacaatggaatttgtatttattccatatatatcatccattatatagaaattatattacaacacaataagaagtgtatattatattatgttataaattttcataatcataatttgttataattcttttaacatttttaatttcatctaattcttcattactaatttcatcacgatttatatattctataaataacggaaataaaattttaaatttattaaaatcaaatttattattagaattatatgtaacacatcgtaacatattttttacattttggtaataacaatttatataatcgatattcaatttatctatatttaatacttctctattatatattttattgttttttttaacacacataggtatattcataattattaacattatcattgctgctgtttctggtgttgtagaagaatttgaaaataattcaatattataattattttttaatttaatttcatctaataatggcaatccaccactttgtaaaatattagtataatttagaaatatagacaataattcattaaattttatattatataaatatttttcttttgctttatttattttattcatatctataattttacctttaaaatatttaattttatctttggtttttatttttttaattatttccatttcttgttcttcgttaattatttcatctaataaatttatttcagattcgtcagattcatcatttgcacaaacttcactatacactagatcatccatatcttcttcatcgctaggctccaattgatcatcatcataatcgacgtccgacatttatattgtgttttttttttataaatgattttatattatattataataattttaattctcacaatatcatattattataaattttttaatattctttatatattttcattatttatattattgcattatatagcaatattagagatatattacgataaattgatagatatagaatatgttttctaataatttatattcgttccacctctaagtcttaataccaaatgtaaagtagattctttagatatattataatctgaaagagttctgctatcatctaattgttttccagcaaaaatcaatctttgctgatccggaggaattccttctttatcttgtattttatttttaatatttgatatagtatctgaactttctacttctagtgtgattgttttacctgttaatgttttaatgaatatttgcattttattagaaaaatatttgttaaaaaaaataattactattctttattttctgtttctattttatctacagcatcaactaatttttcatcatctattttattagtttgatctaatacaataagttctttaacttcgggttttttatttaattctgattttaatgtttcaatttcagtttctacttcttttattctcgtttctaatttcatatcagaaatatattttcttattaaatcattattaaaattatcgatattgtctacaaattcattagaaatagattcagtttcttgagtttctaattcatatgtatctctattgattatgcgtatataataatatataaataataaaataattacaaatgttaataataagaatatgtagctcatttataataaaataaatgttgattatatccttattcttattcattatatttataatatgctttgttcttaacttattattattttattattattatttaatttatacatctgatatatctccaataaataaatctttaggatctatattttatcctatcgaataatatactaatgctatttttttttttataaatgagtgatcaatatactaaattacttattgtattaatattttattatatgcttggttttattattggccattttatatgtgaattttgttttactatttatgaatcatataataaatataaagaagaaaaaaacgaagaagataaattattaattattaatacaataaaagatacactagaaccatataaagaattatttgataaattaaaagccaacgtagaataataatatttttaataaatggaagaagattttgatttaatatctaaaccagatataatatatacgccatcattaattgattttattaataaatatggactaagtaatatatttaaaaataaaaaaataatatctaattataaattttatattttatttatatctatgcaagattataatttatataaaaaaattggtttagaatataaattatttatattaaattttataaaatacatacaagatcctaatgttaaaaaatacattgcagaagtaatagatacagataataccaatatgtataaaaattttagtgattatcccattctttatttatggaaatatgtatataatattaaacaatcaaacataaatgattataatgatatatcatctatgatgtcaataaaacatatattaaacaaagataatgactataaactttatacatataatcataatattattgtaaaatttttattatttgcgtggtattctaaatatgatttaggtgtagaaatattatataaagatacagatgatgagattaataatgatgaaatattaaattttataaataaagaagactctatttttaattatgtaaatcacaataataaagattatcctttatttaatccttcagatgataccattgattcatatgcaaacataagaagcgaaattattagtaataatatagaacctggatatatatggaaaatgcctaatttaataaataaattaatgtctacaggaatagcagaaaatataacagaaaaatatttttctatattatataattatttatgtaatggtgttgttactaataatataatatgctggacttatttatttggttatggtaatgtagatcctattttattgaataaattattttctataataatgaaaataccaatacaattatcaggactaatatcagatttatataataataaaaattttaaagcaattgataatataaaagaaaatattagtaataacacaacatataattattttcaaggacaatgtaacataaatatagatgatgcattaaacggaatacctaataatattttgaatactatagttgaaaaagattttactccacagggttattttattaattttggtatagatattaacaaaataaattttaatgaaaatttttttaatatattattaaacaataatccaatttcaacatctatggatgatataaaaaataaaattaaaaatacatataataaaacttatacaaaatattatatagatatatataatactgtcaattatataaattctaataataataattttgaagctgttatagattataattttacaattttagatgaaataaatgaaaaaaatttaaaatattttaatcttcctataataaaaaaggaaattttaaatattttatataataaatattattttattcctgattgtaataatataaatttatctaaacaatataataattttatattaaaaaaatcacgtcttataaatatttataattgtttaataaattcagacattgagaaacaggtattagatttaatgaacaaaaatacatatttaaacattttatttagttaatataatcaatgattatttattattttttatataaatggataatgttgaaatagtttattatttattagctactgttatatatattattatgatattagcaattattggtattatatggggatttttactctcaattaataaaactagagcagcaataacccaatcaataagaaccagaagaaaaggattatattggtttatgaattttacattttggttagttccatttgctttagtagctggtttttatttttttagtatatggtttattatgaacccacaagcaaaaatatattggtttcctcatccataatcacattaacattatactatctaaaaatgatttttttttatctgtattttttaatgattttttatatttcatggcatattgcaaaatttcaaaattatcgatattaataaatgtggattttcctttaatatttttataaatatatatatgtggtgttttaattactaatttttttatattttcatcatctttaaataattctaatactttatttccaattttattaatattaattctaatataatttattttatttttattagataaatgatctagaaaatcatttattatttgacatatcttacattcttttaaatacatacatactatagttgttttttccatttatataataaatttataatatgaaatattatataataattaaaaaatgtattatagcaatcataatttattaatagattttataaaaataaattttttaatacctaaattatattctatttctgtatctaataatataaataacattgaaaaatatgttaaatatcataacaaacttgcaaaaaatattaataaaaaatatagaaaagacttatataaatatatagatatagatgaattatataattttaaatattctatatctaatagaaaaatacctttaaatataaatacaaaaaattgttattttttaaatgaaatatataaaaaagatattattaaagcttataaatatacatctggaatagactctataatatatcataaaataaataaagtaactgatactatattattcttaatatataaaaataatggaatggaaagaaattctgtcggtagatgtaaacgattagaatattgtattaatatttgggatgcaattcataaattagattataatttatattataaattaaatttatttttaaaaaaaaattcacaaatagattatatcagatgtatattatcatcagataataatttagatatggaaacaatatatttgaatattatgaataa

SEQ ID NO: 26 - DNA, 50000 bp, Amsacta moorei entomopoxvirus
tataaacatgtattgtaaatttaatattaatatattattttatagaaaaaataatatttattattataatgatccgttaatatttaataatctggaagaagatattaatttggaaagtaatgaaataatatttgttgataataaaaacagtataggtatgtgtagaaataaaatatccaaagtttgtaaaataatcaataaagaagttgattgtaataatacatcattgaagttaaaatttaaaaatttagttgggaccaaagtatataaaattttattaaatgatatacatttattatattattatgatataaatagtgatatatatatttatttagataattctaatataaaaaaattttattcaaataaattagttattgataataatattgtaatatcttcaaaaattttcatacataattttaaaatatataatactacaaatgaattagaaaaaatatgtatttataataatatatatgaattaacaaaagattattttaaaaacataaatataacacataacgatgatttatatacaagtatagaaaaaataaaaaaaaataataatatagaattatttaaaataatgaataaattaataaataaaactgtaaaatatcatatgcaaataatatcagaaaacaaacccattgatttaaataaatatgatattctatttgattttttaacacatatatataaaaattcacaatctaactgataatagatgattattatattctaatactatgggaaccgtaacaatatcatttttaaaatatgttaaatagcaattaccaaatatatcattttctataacaaatgatgattctatagcattattaatatattcttttattttatcattatatttaatatctatatttttaattatatattcgtttaatgttgtaaatttaaatcttgtattgtaataacaatatcttcggattttttctaaaacaaaacattccaaaacatcactctcgatggtatctgaagataaaatagttagatttttaaatatattatcagctactttagatttttcaaattttaattcagaatataattgttttctaaaatcataagataaagtatacgaactttccgttaacaataattcaattttatttaataaagtatttttataaacatcagaaatattaacatctttatattgttcaattgttttagaaacatcgttacttaatgtatttgttgttgatgcaatacatattctaattattacttttgtattagtatctttataagaaaatgatctaacagctctagctacacattgatctaattcagattttgtttcaggaacagttaaaaaccatatatcttttacgttttttaaagtataagcttctgatataatttttgaaccaaataaaaacattatattatttccatcatcattaatatcttcgttaaaaatacttaaaatattatttatataattactatttcctttatttaattcttttgatgtaattattacaaatctcataggaatacattctccattgtgacaaattttatcctttatacaattaacacatgtaaaattattaacaatttcttttccatattcagatatgccatttgctaacataacacttcttattatagcacttcctatagtactattagcaaaatatacaaatcgtttaccaacatttctttctttaaatatagtatctctaaaagtttttaatttagaagatatatttaatgtaactaattcagatcctgaaaattttccattagaaatataaaaattatcaaatatttttttatctgtctccataaattgtgaaaaattttcataatttgatatagatcctaatgcaaccaacgaaacactcattaataatttaacaaacatatcatttttagtatttctagctacttcataataattttcttcatgtaatttagacattggacataatgtcaaaggacatagaaatatttttttacctctgtattttacttcaggaacatctttcctctcttcatcataatatgatattaaaccctttagatttttatttaaaaatgcaataccttcgttatttatacttttttcaaaaacacgatttccacctattttaatatacttattttcatcaaatgtttccctagttaataattccacaatatcttttattgtcgaaacagtatttgttatcggactacctgtcaataaaacatatattatatttgtattttttcttagagtagataatacactacctgtcatatttccaaaaaaattatgtgcttcatctattatcataatataatcgttataattttttaatttttcatttattatatcagttttacctattaacattatatcttcgtttaattttgttctagttgtaaattcaatattttgtaaattatattctttattaggaagtaaaattaaagatctatataaattttgtttccacatttctaatatactataactaggcaatactattataacttttttaatattacatattaatatgctaaacaaaagagaaataattgttttaccagaacccattttatgaaacaataaaacactattagcattatttatacatttttgatataaaaaatctaatgttgctaactgatgaggcaaaatttgagcaatattgttcggaatattatcatttctcaaatcatctaatataactttattcattatttatatatttcttttttaataaaaataatactatatatcatattgttcattttcaatagattttataatatttatgaatttatattcttcacaacgatttaaagtaaacttatttccattaatttctataaaaggttttctatttcctaatctatcttttaaaatacttttatcttttattctatctttaagattgttaattcttattttatctaattcatatattttagactttaatctagaacacatatcaataggattaggattatatttttcatctataattacgttatgtttttctagccaattagatttattagtttttatatattgatcttgagctcttataaatttatattcattattaataattttattttttaataaaagatatttatgttgtaatttaacctctttaggttttacattcctatcttctattacaacatttaatttatctttaacatcttttatttcttctttagtttctataagatttattcctaattcttgtaatttatttaaagctaattgattttgtgttaataattcgttattttgtttagatatattatctaatttaatcgataaaatatctattttatcttgcttattattaataatatctatatattttttttgtgttcttttacggattgttggcaataaatcaaataaaataaaatcttgaaatcctttagcagaatctttagtacaatgtaatataatataatatataccaggttcatttaaataaatagctttatttttattatttttcgtcatagacaaattgtccctcacggaagataatatgttatacatattatctttaaatttatcatctaatctattaagtattttattatgactatcatcgctgtattctaatgcttttaaaatatttttaccacaaaaccaaggattattaatcgtaccaattacttttatttttacatcattataattaaatatttcattaaatgtttcaataaattttatatctatttcatcgtttaaattataatttaaatcggaatatgtagaatctttaataagtatattttccatgtttttataaaaattaatatattatttcaattatatatcatattgttcattttcaatagattttataatatttatgaatttatattcttcacaacgatttaaagtaaacttatttccattaatttctataaaaggttttctatttcctaatctatcttttaaaatacttttatcttttattctatctttaagattgttaattcttattttatctaattcatatattttagactttaatctagaacacatatcaataggattaggattatatttttcatctataattacgttatgtttttctagccaattagatttattagtttttatatattgatcttgagctcttataaatttatattcattattaataattttattttttaataaaagatatttatgttgtaatttaacctctttaggttttacattcctatcttctattacaacatttaatttatctttaacatcttttatttcttctttagtttctataagatttattcctaattcttgtaatttatttaaagctaattgattttgtttatttaattttaatatttcgttattttgatattctgttttattaattaattcgttattttgtgaaattatttttttattttgattaaataattcatctattttacatttttgattatttaaggtatttaaatatttttttaaagctaattttctaattgatggtaataactcatcaagaatatatttttgaaaatctttagcagaatcttttgtacattgaaaaactatataatataatccagattcatttacataaatagctttattttcattgttttttgtggggggtgttttacccccctcgacaattatatcatataaactttttttatatgaattatttaattcttttaatatagatttataactttcttttgtatatccaaaaccataaattattatatcttttagacaaaaccacggttgatctatagttccatttattttaatatctgtatctttaaatttaaatattttattaaaattataaataaaattatctgttaacgtgtctattgaactataattcagttcaatagaattattagacttaataagtatattttccattattaaaaaaatactattatttcaatataatattttaatcagataaattaatgaaaaaatattaataaaatataaatataaaaatgggcataaaatatttatataataatttattatcattagatttaataaaaattcataataaacaaatttcaaaacaatatttatatatagatttagattgtattttttatacttatgcacatatttgtgaatcagataacgaacttattaataaaattgttaatataatagaagaatatataaataatgataatcatgtaactgtattttatgattcaggaattataaataaaaaaattaacgaaaataataaaagaacagcatcttcattaaaacattataataatattaaagatgtgtttaaacaaaaatataatatgaatgattcttatgaatttgagtataaaactacaataaataatatttctacacaaacaaaatatacatacaataataataatattttaatagacaacgtcgaagaagattttactgacaattacacagatgataatattaaatcaacacaaacttgttttatttttgaccaaaatgaatataatatatgcgaagataatgttaatgtatataaaaatgaagtaattaatatactagattcatctacaataattgaaaataaaaaacaattttattcaatgagatttaatttagaaaaagataaaaaaaaaatattaaaacaagaattattaaataatataaaaaaaactggtgttaatattgtaacaaaagaaggtatagacgctgaattatatatgatttataaatgtattaaaatacataaaaaaaataaaatatggccattgtgtttatctaaagatcaagatacaattgctttatctattattaatataccatataatatatttaatatagtttatgataataagttatataaaataaaaaaaaattcattatctattaatttagttattttatctctaatatttaatgaatctgattattttggtggaatatacggatattcatttagtggtgagaaaataaaatatttgattgatataattgaagattatgatattaataatttattggattattttaatatagaatacataaaaaatttatgcaaaaagttatttttaaaaacaattaatgaagtaaaattaaataatatattaaaaatacacatggctataaataattttcaaatagaaaaatatttatatgaaatatctttatatttgttatgtaatgaaaatttttacaatactggatataataatcaaatagataaaaatgaatttataaaatatatatttttgaaataatactattaaatattaatataatatatgctatattatagatataaaaatggaagatatattaagtaaatatgaattaaaatataaattaaatgaagaatacatttttaatgagaaaaaaataaaaataattggagatgtggtaaaaatatattttaattatttaaatctaactaatataatggaaatagatccaaaaatagaattttataatatatcagatgatgataaaatatttaacgaaaacgaattatatatatcagaaaaatgttttttcggtattataaataaatataatacagaaaattctaaaaatttttcaaaatatataaataatattataatgaatactcgagagaatttaataaataactttcttaatattgtagatgattttaaaataaaattaatgaaaatgaataaacataataaaaacttaaaaagtacgattaaagtacaagcaaaagagttaatagcaagagaacaaaaatttcatgatcatattagaagtatatataattttattgaaaatattaatttctgatatattaaatttttatatttaatctcacaagatctgatgttctatatatagtacaaatttgtatgattaattgatattttaaaattcaagatattaaatattagattctaaactattcttctcattatcaatataactatcataatcattttttattttactacatacattcataattctattactattttttttatacatatctattaattccataaactttttattttttatattaaatatttctaatgtatttttaaattcgtcaatactattaatatcatatctagaaataaataatgcacctctataactactagccaataaatcaccaataaaactcatagaataatataattttttaaattcaaatttagattttatgttgaaataaactatataatataaaaatattatattaaacataccacaatcgggactatcatattgtaattcaaaagtattaaaaaagtaataatttacatttttaaatatatcatttaaatattctgatagtacatcaatgtataaataagcataattagtattaggagtactattgtagtgtttatggctttttatagtcatatcagattcaataaacatatattttttattttgttttataagttctggtatataaccactactattaaaaaagtatgcagcttttttatctttatcaaagtgtttatctattacgcaacaagtaaaatgatcattataaattataggaaacataaaaaatctttttttatcattcattaaaaaaaattttactctatcttcaagtttatagcatctcatagatgaagctactgtagcaatatttttatcagttttttcaaataaaatcaaatgaaaataatcataatctgtattaatcatagttaatggatatatacaattatatatatctcccgaacttaaccatgtagatttatcatgttttcttgggtaagctttaggtttaggattaaatcccaaaggcggtattcctatttgagcatccaaatcatcataaattgtggcaaatgtagaaaaatctcttgttttggataattctgattttagaaaagactttctcatatatactaatggaatgcctttatattttttagatgtaataaaagtattaatatttatatttttatcttgtaaatatttttttatagtccaaaatagaaaaaattttcttttaatattattttcaaaattaatattattaatatgatttggatctaaaactaattcattatataatatttccaagtattttataggtataaatgttactttacctcttgtttcatcatcatcatctattttttctaatatagctatatttgcattagtattatatttaataggatttataaaatataccatattatctattttactaaaaaataacatagacataaaattaataccagattctggcatttttaaatttttatttggaaatcttctaattttattattcattatttatttaataaatgtttctagtttatttcaatacatttttaataataattttattatttggtattataggtatttatatattaacatttgtgtttaatatagattttttaataaataataataaaatatatatattatcatataacgcaactaatataaacaatataaataatttaaatttatacgattattcagatattatatttttgacaaattttaacataaataataatcttttagtaacacaagctaataatttacaagatataccaatatttaatgtaaataatattatatctaatcaatataatttttattcagcgtctagtaataatgtaaatatattattaggattaagaaaaacattaaatataaatagaaatccatttttattatttagaaatacatctctagctatagttttcaataataatgaaacttttcactgttatataagttcaaatcaaaatagtgatgtattagatatagtatcacatatagaatttatgaaatctagatataataaatatgtaattataggagaaatacccgtaaataataatatatctattaataatatattaaataattttgctattataactaatgtgagattaatagataaatataactctataatatcatttttaaatatcaacgtaggaacactttttgtcataaatccataatatttagtaataatcactaacatattttttattaaaatgaataaaatatatattgttattgtcaatattttatatcattttacagtcttattttttttttttgcttttaggtataattttaccttctaaacgtttatctccccaaacatctacagtagatggtttattagattctgtgttatacacatctgctggatttgcggcatttgtatccaaaccataatatccaggtctataattatctttaaaaacttgggattgagatacttcttcagtttttaaattattaaaatatccaagattatttttttttgatgaagacataattgatattataatactttatagatatgtcaatatttatctactatattttcaacaatagattttatatatataaaagaatgaatactgtacaaattttagttgtcatattaataacaacagcattatcttttctagtttttcaattatggtattatgccgaaaattacgaatatatattaagatataatgatacatattcaaatttacaatttgcgagaagcgcaaatataaattttgatgatttaactgtttttgatcccaacgataatgtttttaatgttgaagaaaaatggcgctgtgcttcaactaataataatatattttatgcagtttcaacttttggatttttaagtacagaaagtactggtattaatttaacatatacaaattctagagattgtattatagatttattttctagaattataaaaatagtatatgatccttgtactgtcgaaacatctaacgattgtagattattaagattattgatggccaatacatcataaatacattataatattattataatatcaatcataatttttatatatattttatctaaaaggactttttattttttatatattaataataataaatgagtaacgtacctttagcaaccaaaacaataagaaaattatcaaatcgaaaatatgaaataaagatttatttaaaagatgaaaatacttgtttcgaacgtgtagtagatatggtagttccattatatgatgtgtgtaatgaaacttctggtgttactttagaatcatgtagtccaaatatagaagtaattgaattagacaatactcatgttagaatcaaagttcacggcgatacattaaaagaaatgtgttttgaattattgttcccgtgtaatgtaaacgaagcccaagtatggaaatatgtaagtcgattattgctagataatgtatcacataatgacgtaaaatataaattagctaattttagactgactcttaatggaaaacatttaaaattaaaagaaatcgatcaaccgctatttatttattttgtcgatgatttgggaaattatggattaattactaaggaaaatattcaaaataataatttacaagttaacaaagatgcatcatttattactatatttccacaatatgcgtatatttgtttaggtagaaaagtatatttaaatgaaaaagtaacttttgatgtaactacagatgcaactaatattactttagattttaataaatctgttaatatcgcagtatcattccttgatatatattacgaagttaataataatgaacaaaaagatttattaaaagatttacttaagagatacggtgaatttgaagtctataacgcagatactggattaatttatgctaaaaatctaagtattaaaaattatgatactgtgattcaagtagaaaggttgccagttaatttgaaagttagagcatatactaaggatgaaaatggtcgcaatctatgtttgatgaaaataacatctagtacagaagtagaccccgagtatgtaactagtaataatgctttattgggtacgctcagagtatataaaaagtttgataaatctcatttaaaaattgtaatgcataacagaggaagtggtaatgtatttccattaagatcattatatctggaattgtctaatgtaaaaggatatccagttaaagcatctgatacttcgagattagatgttggtatttacaaattaaataaaatttatgtagataacgacgaaaataaaattatattggaagaaattgaagcagaatatagatgcggaagacaagtattccacgaacgtgtaaaacttaataaacaccaatgtaaatatactcccaaatgtccattccaatttgttgtaaacagcccagatactacgattcacttatatggtatttctaatgtttgtttaaaacctaaagtacccaaaaatttaagactttggggatggattttagattgcgatacttctagatttattaaacatatggctgatggatctgatgatttagatcttgacgttaggcttaatagaaatgatatatgtttaaaacaagccataaaacaacattatactaatgtaattatattagagtacgcaaatacatatccaaattgcacattatcattgggtaataatagatttaataatgtatttgatatgaatgataacaaaactatatctgagtatactaactttacaaaaagtagacaagaccttaataacatgtcatgtatattaggaataaacataggtaattccgtaaatattagtagtttgcctggttgggtaacacctcacgaagctaaaattctaagatctggttgtgctagagttagagaattttgtaaatcattctgtgatctttctaataagagattctatgctatggctagagatctcgtaagtttactatttatgtgtaactatgttaatattgaaattaacgaagcagtatgcgaatatcctggatatgtcatattattcgcaagagctattaaagtaattaatgatttattattaattaacggagtagataatctagcaggatattcaatttccttacctatacattatggatctactgaaaagactctaccaaatgaaaagtatggtggtgttgataagaaatttaaatatctattcttaaagaataaactaaaagatttaatgcgtgatgctgattttgtccaacctccattatatatttctacttactttagaactttattggatgctccaccaactgataattatgaaaaatatttggttgattcgtccgtacaatcacaagatgttctacagggtctgttgaatacatgtaatactattgatactaatgctagagttgcatcaagtgttattggatatgtttatgaaccatgcggaacatcagaacataaaattggttcagaagcattgtgtaaaatggctaaagaagcatctagattaggaaatctaggtttagtaaatcgtattaatgaaagtaattacaacaaatgtaataaatatggttatagaggagtatacgaaaataacaaactaaaaacaaaatattatagagaaatatttgattgtaatcctaataataataatgaattaatatccagatatggatatagaataatggatttacataaaattggagaaatttttgcaaattacgatgaaagtgaatctccttgcgaacgaagatgtcattacttggaagatagaggtcttttatatggtcctgaatatgtacatcacagatatcaagaatcatgtacgcctaatacgtttggaaataacacaaattgtgtaacaagaaatggtgaacaacacgtatacgaaaatagttgtggagataatgcaacatgtggaagaagaacaggatatggaagaagaagtagggatgaatggaatgactatagaaaaccccacgtttatgacaattgtgccgatgcaaatagttcatcttcagatagctgttcagacagtagtagtagtagtgaatctgaatctgattcagatggatgttgcgacacagatgctagtttagattctgatattgaaaattgttatcaaaatccatcaaaatgtgatgcaggatgctaaatgaaatttaatattatataatattaacttacaagttataaaaatcattaaaatgattttttaaaatgatattatcgatagttgtgataatgtgctcttttattttattaattgcgatgattataatattatcttttagatatatttaatattaattataaatcgactgacaataatatttattcctattcataataatcatctgctatatatattaatgtatcattctctattataaatataggtatattgtctttatcaatcattaattttgctacagctgtattatctttatatactatatttgtgtctttgtttaataaaccttttaatatagtggctctatcataatctttacaatatgatatgggatataattttatattaataataacattagatacgttcatttctttcattctagttttacgtattgtgtcaaaaattatttcattttctgctggttctatatatttatatgtgttatgaatagattcgatagatgatgattttaataaatcaaatataacatttattttaccttgtttatcttttataatatctaatatttctttatctacagattttctgttgttggtatatgatattaaaaaatgaacgttaacatatctatattcttgtggtaaatctttatgagaatttaatcttatagatcttcctattatttgttttaattctgattcattccacggcatatctaatataattatatcattaatacatttgaatgatatgccttcagatccagcgtaagaaaatatgcaaacttttacttttttaccattattattttcataattattatattcgtttaattcattatctctagtttttaaagttttgctagaatattcaatataagaaatattaaaacaattaaaataacattttaaacttgatattccttcaaaattaactaaaggttcaaatattaatacttttcctctcgaatttaaaattattttacaagtttctatatatttacacgaatattgatataatatattataattatttatatcagtgattggtaaattagtttttatttttatattatcatttttaaaactttcaataaaagattcagagaaattaatattttttgtaaactcggaaaattcagcaagttttcttttaatcatatcattatattctatattatctaaatctccttttattttaagatcataaaaagcaaatgaagatattaatcttctcatagtttttaaaccacctaattcagttttataatcatatttttctgccatattatataatttagattgctcatctgacataattatattatgataaaatatatttttttttgcatatccatctatataatttgtttctgttaaactatctgcttctattaatcttttataagaacatatagctaataatgtttctcttaattccttaaaattaattaactttccattatttatatattcttcttttatattcataacatttggtctaagtaaacctattaaattattaaattcagaaatattattagttactggagtagcggacatacataatattttattattttcgaaatttgctaattttattaattttttataaataggagtaaaatttctttcgttattatcttttttaacagttcttgatattaatttatgaacttcgtctattattattagtaatctactttttttattaagagaactttctatagatctatatatattattaaatttatctaaactagatgacgaatcataatatataaattttatattactggtatctgatatatatgatcttatagtatttaaccaaggatctatgtataatgattttttaataaatattaaaattatccatcttggaaataattcttttatatattttataatatacacagcagttaatgtttttcccataccagtatcccaaaataataacatactattcaaattttttaatcctatgaatattctacttacaaaatattgataatcttgtaatgtaatttcagtatttgtaatattattcataattttattaggcaaatgttgtgttttatcaagtgcataatttatatgtttaccaacaatagaatctaatgcaaacatttagttatataaaaaataatatttatattaacttaagatgtttcataattttatgtctgtgatgtggagttaaaacccaagatattgatatatctatatcattaattcttcttttgaatctatgtctatcaatcgcaaatttatcccagtataattttcgagtttgttttgcagcatataaccaaacatacataatgtggagttttggtggttcggatgaaaagcgtacttttttcgacggtttatgttttaataatttattattattatataattttaaattataatatatattatttttaaataaataattataatacatatattgtatataatttttatttattatatatattaatttataattatataatattataatatattcttctagtatatatataaatatattataatatgatatatatttatcttctttaaaatgttgatatttttctataatttttacgttcatatttataatttatttatctaatattaaaatatatatagtttaattaatcattaataatgtatgtattttaatatgtaatattatttataatatttatatgtaaaatataaatagcatatctatgaaaatttattttttatattaaactataatgaatcataatattaaaatcgaaaataataaatatagtgttaaagacatatttattgcattaaattatactaattatgaagaatattttgaagataatgaagatagatattattcacttagatcacttaaaaaaatatttaatgaaaatgaagatgaaaaaaaattaattaaatttttaaatgataatacattcgtagatatatttacttttattaaaaataataattatgaatttaaattaggtgagtggtttattgatatatggtatcctttatttgaaagaaaagatgtattaataactaataaaatattatactttatacattatggaatatcagggggggatactcatccccccctagaaaaatatagattaatgcgtaaagatttagaaaaaatattaaaaaattataatattaattatataaaaataaaatattataaaaatatcgatatagattataattttttgatcgatgaaataaaaaatattactcctaataatattattcaaaaaacgtggataaaactatctgttaaaaattttaaaaaattaatattaaaaataagaactgcaattgctgatgatataagagattattatataactttagaagaaatactatatgattattcaaaatatataaaagattataaattaaaacaattagaactatccaaaaataaagaaatagaacaattaaaattagaaaaggataaagcagaaagaagatctttgagacttaaagaaaaatttatagaagaaaaaaaactcagatcggatcaaataatttatatatcgacttctaaatcttatgctgcacaaaatagattcaaaataggtggtgtagaaaataataatttgataaaaccacgtttgtcaacttataattctagatcagcagaaggagatgaatggtattatacatatataaaaaatataaataattacaaacattttgaaaatagattttggtctgttatgtcatcttttagagataaaaaagataaagaaattatagtattatattataacgatttaataaatatatttaattttatatctgaaaattataatgaagatattgaatattttaataaaaatgttaaaatatttattgataatatagataatgataaatattacatacccgaaccttttaacatagaattagttaatatatgttctattaaaaatggcaaaattgataataaacttattgtagcaacaaaagaaattataatagacgaaattaaagattattttaaaaataaaattaaatctaatcaatatgaaataaatagaaaagaattaaataaacatatagataaaaaatataaatttaataaacgtgatttatggaatttaactaaggaagttaagtctatatttaataatattattttaaaatattaatttaaaatctatttatatttatatctaataaataatacattatattattattatttaaattgatataaataaatattaatattaaaatatgaacttagattttttatattaaatctataatattagaatatatatcttctatattttatattaaaaattaatatatattataacaatatatatctaacgccattattattaactattacatttttatcatttatcctagttgcaacgttttcaaaaggaccatataacacaaatccaatttttaattcatatataaaaacttcaaaataatgtattcctaatggatcaaaatcctctggtgtaaatacataatcttgtatatatttattttctcttttttctttaatagtcattataccactacatacagtactttcatcaggtcttaatattatatctgttaatggtctatttatagaaaaagatacaaccaaatcattaaaatctctaacagttatagtaaaaatcataaattctgttaatcgtaatgttttcataggataattacaatatatcttataattttctatatgcacttctctaaaattattaaaaaatcttattggtgaatttctccatataaatattattatatctaatgatcctattaaatcataatttaaagtcatatgatttacggaaactatactattatacgttagtatttcataagattgcattctataatcttgtgctgtatatcctttagctacaaataattcattatcatttaatatatatcccacagatgcgtgatcattaccttttattgaagaatttatattattagtaaaaatattttgtatttttaaaataccaaatcttgcatttataaaactgataatatagttactataatatggattagatatttctatactatattttaaaaatctattatttatatttatatcatcattataacaaaaactagaataatttgaagatgtaataccataaccattttttataacacgcatagtaccatttactgtgtgtatatcaaatcttgttttttcattatttaaataattcaatttatttattagtgtaggaaataaattagtattttgtatggaatttatatctaatattatattttttaataaataatttgaatctgttatatatgacaatatttctggatatatataagataattgaaatataatttgagttatatatgatgattgtgtagcggattctattttatatcctactgtatccataaaacatccgtaataatgtaattctttcattacaacatcaaaatatttttgaattaaatcatcatttacttgtataaataatatatattttgcaaaaattattacatctaatatttcagatccttctattatagaacctggtaaaagtggagaattataagtataacttccatctgaataaaaaccaggagtattatttaatactttgcaagataatattaaaggtggtgtgttaaatattaataaatttctattatattcatctgtattaagttctatatttaaactatatttttcgttaatagtatacataattatatatatcaatgcattagaataaacatattcattatttttatattcgaacatatgctttaattcattattccattttataaataataaaaatatttccgttaatacttctttatttaatttagtataatctaataaaaatactgacatgcaaatatttttaggtatacttatagctttataatatttattagtgatagaaacattggaattatttaatatatttgataatatatcgttaaatatcgaataattatcaggattaattgatattcttgtgatatatttaaaataaaatgatgctatatttatttcttcgtcactattataatttatattttgtatctttattaatgataaatgatatttttgtaataaatagtcataatttgtttcatctatttcttcttcttcatatttttttttataattatataatattaatactaaaaataatattactattagtatgtatataataatcatttattattatataataatatataattgaaaatttattaaaataatttaataataattaaaaataatatatattttgatataatatataataattaattaaaatggacgaaacaataaattttaataataaatcatgggaaataaaaaatttaatagctaaaggtggttttggaacagtatataaattatgcgaaaaaaatgataataataactgttacgctattaaaatagaaccatcggataatggtccgttgtttgtagaaatgcacttttataaaaaaataaataaaaatgaaataaaaaattttattgatgcgaaaaatttaagttatttaggaataccattactatatcataatggtattataaaaaaagataatatagaatatagatatatagtaatagattattatgaatttaatttaaatgatatattaaaaaaatatataaaattacctataataacaatatataaaataactatacaaatattatatatattagaatatttacacaaaaaaaaatatacacacaatgatataaaaaaaaataatataatgtttaattcatcattaactaaagtatatttaatagattacggactaatatataatatgaattctaatcaagaatataatataaaatgtagtaatgatggaactctagaatatttaccattaataactcatttatttggcttaaaaacatacatgggagatatagagtctctgatgtataatattattgaatggtatagtggaagtttgccttggattaaatataaaaaaaaaaatgttatattaaaaaaattagattttttcaacacttgtttaactaattcaccaattgaaatatgtaaattatataattatataaaaaatgctccttctatatataattataattttatacctgatcatgataaattaattaattattttgtaacttatttaaaatctaaaaatataaatttaaatgataaattagttttttgtaaataaaattaatatttttaaatatgtataaatatctatactttataataatatcattatcaaaatacctggatttaataataatagtatgagttttactataacattcgatatagaaaaaaatttatgtattttaaattatctttcgtacctaactgatataataatgtaattggtaataatagagctcttgaaattagatggattgataaatgtaatgatataaaatttgaactattacacaatagtaattatactatatttcaaaataaatatattttatttatctagaaacaattggttacaaatatttaatattagacataataatgtatctactagagtaacaaacaaagaatgtataattaatataaatcaggaatctgtggaatttaatataaaaaataatgaaattatattatatttagataaagattttggatttttacaggtaataccttattttatgataaatatatatatattctagatgtgattctataatatggtatacttataaaatatttattataatttttataattatattatataaaatatttatttttttgaataaagatttaataagtatcatcatacgagacatttgatacatttctgctaatattatcatcgtttaatccagtatattcattaccaatatttacgaacatagatctaacataaataaaaaatgccaatgttattagtattatattaaaataagctgctactgcataccaagttgaattatcgtcatatatataattttgaataattataaaaagtaatgaaataataaaagatattaataatagtattaaaatatatcttacggcgttatttgatatgttaattagagtttgtgcaaaactaattcccgcaatattgttcatttattgagttataaaaatgaatcatattaaaaaaattttaaaaataaaaagtgataaagatatattaaattacatagatgcattaaattataatgatttagaaaatataatacagacattagataatagttattatgataaagaagctttaattagtgataaaaaatatgatttaataagaaattttataaataataagtatcctaatgaatctttgtgtaaaaaaataggttatactccggaagataaagtacgattaaagtattttatgggtagtgaaaataaaacttataaatcagataataaattattaagttggataaacgaatatcatactaatatattagtattatctgcaaaagcagacggaatatcagtattatgggatataaaaaataataaaatatatagtagaggtgatggtaaatatggaaaagatataacacattttattaattattttaatttttcagatgataaaaatataaataacaatgatatatttaaaaataatataaattttgttagaggtgaattagttatagataaacctgaaaatagaaatatagtagcaggtcaaataaatagaaatgaaattgataaagaaaccgcattaaaaatatattttgtagcatacgaaatattagaaccaagaatgacacaactcgaacaatttcacaaacttacagagaatagtataagaactgttaaatatgattctgttgattataatatttcatacgaacaattaagtgaaatatataataattatacgcaagaattatcgtattacatagatggtattataataagaaataataatttaaatccagttattaaatctggtaatccaccttggtcaatatgttttaaggaaacagataaaatatatattactactgttaaagaaatcaaatgggatatatcaaaaaaaaatatatatatacctaaagcaatattagagcctataattatagataattcgactattaatgctgttgcttgtcacaatgctaaatatgtaattgataaaaaaattaacactggttcaatagtagaaatagtaaagaaaggtggagttataccgataattaataatgtaataaaagaatcagatatagaaattatattacccgatggtattttatctggtgtaaatattatatttactggtgttaacaaagaaagtgaaattaaaagaatattatacttttttaaatcatttggatataaaaatattaataaaacaataattgataaattatatatgttaggatatgtaaatatattaaaatatttagaaaaagatattaatatagaagaatataataataaaaaaacttatattaaattattggaagtaattaaagatataaaaagtaaaaattataatatcgtagacatattaacagcattatctctagatagtatatcaaaatcaagagtttgtgctatttataatgagtttccagattttttgaaagataaaaatgaaaaagattatagttcaataaacggtattggaaaatctatatcaaaaaaaattaatgataatattataaataattacgaatatataataaatattttaaacgctttaaatataaagtattaatttttaatttatacaattaatttttatatatttcgatataaataaaataaataatttaaattcactaacaataatataatacaagtctttatatttttatttaaaattaaaaatgttattgaatatactatattattataataataaatgtccgatattactatatatcaatcagcaaatatcgcagattcgttttttaatgatatattaaacgattctacagaaaaaaataataaatatataatatttatagattggaataactctatggttacttataaaaatgatggttttgtaatattacgaaataataatgggtattcgcacgattcatataataatataataaaaaataaaaactgtaaagggttttatataataaataataattctagcaattcagaagatatacataattacgttgaatcatatgacattgatatagaatatatatttaatttaaataaattagatcccaagatatctgataataataatattaattataatatagatttttcatatattttatcaccgaaatataaaaatacgcgttatcataatataatagattcatttttaaatgacaattttataaacattaatccgttaataaaaaacaaactatcaatatatataataacatctaatatgtgtaatataatcgatattttattattttcaaataatcaatatcatatattttattatcaaacatacgatgatgaaaaattatttattaaaaaatatggtaaatcacatcataataaaaatgtaatttattgcggagtaataaatgatactttaaataaaataaagtcagcttggaaataattttgaaaaataatataaatttatataatacattattacaatggattctaatgttatagaaataaaaaaagaagaagtaaaattaattaattatgcaaatttttcgacgtttaaaatagaagaaccacactatgatataccaaaaaataataaaagtatatatagtacacccgttaaaataataaataatatagaagaaactatacatgcggaagattgtatttcagaagatataacaacatataatatcaatgatgataatgaaaatatatataatcctacaacaataccaaaagttaaaaaaaaagtaaatataatattaaatattattttcgcaattatatttatcattgttttgttaataatgtctcttataacatttaaattaatattatggtaattatttagataataatttagactttacttcgttatccaatattaaatttatatttaccatatgattttttttaaattctaaaaatgtatttacgatatgatcattaacatttttattttcttctgctgacacagcatcagtaaaatttttaacacaattatcacatttgatcgaatcatttgttattatatttatattatcataatccatatcaaaaataaaatctgccatttaaatatataatattattaaaatatattaaatggaaaacaaaatagatataactattttacattctttagtatcattagacaattataataaaaaaatattatatgatgatttatcatcaactatatacatagataaatataaaaatcaattagtcaactcaagtaatattagttatataactattttattaataattataataattataatattaattttattaatatttttttatagaaaaaactaccacaaatatatttataacacatatattaaataatattacgcaaacatatattattttttatatattcattaaaaataatattatttggtctaaatataaatttattattagatttaatcaatgatttattatataattcaattatatatttattccatatttctggtttatcgtctcttttatttagtttgctataattgaaatttattacataatttatattaagaatatcaaatattctatctaaacagaattcgtaagatatagtttttgtataattatttttatatataaattgtgtaaaatcctcaaaaattatattaattctaaagatatcgtctttagttaatatacaattattaccatccgatagagacatattaattaatttatgcgtagttctataattttttataccttttgattttaaatattcagaacctaacgcagttgttatactttttgtatttaaattattatcattgattagttttagaaaaccatctactatatcatatgaaatactggtatttgatatttcttttaaaacattattacaatgtatagttttattgtttgaagcactacttattgttgttattctttttgacgatgttgtataacaatttgagcaatcacaacatgaatatatatctttattttttattatgttaaaagaattacaatatttacattttatattatcgctcatttatttatattatttattataaactataataattttgaaatattattattatattttaaaaaatggataaatatatattaacgaataaattatatgatatatcaaattattatgcattatatctatatacagatattaaaataataattaataaaaataaaaaatttaaattctatgatataaaatcattaattggtattgaaatagaagaatggataaatgataataataaattattatctgataataatataaattttattgaaatatcacacgacgatcctattatacatggttattatacagatttaaaaaatataaatatgatattaatattatttaatattacagattatatagattatatatctaataaaatttttgatgcgatatctgacaattttataaaaaataaaatgcaatatatagaaataatagaaacaaaaaataaatataatgatgaagtaattaagttagaaaaatatactaaaatgttagcatatgaaaaaaactatattaatcaataagttattgttaattttttatcattataatttataggtgttttactatttttccactcaaatatttgcttaatataatcccataatttgattttgttaatattatctatatttattttatttaataattctattctagatatttttaaattattattttttatatattcatctagaatattagttattttttctttaatttcatttaattctatttctttatcatttatgataattttatttggtataataggtttaagattatacatttcagataatttgttttttattaaattattaatataatcatatggttcattaatatttttaattactaaattaaccatatctaataaatatttgtaatgtattacaaatatttcttttctctttttatctctaaaattatctaaaagatcatgaattaaattttctgttttagatatattaaatactttttcataataacatatataaaattcatcttcagtgttatgtgaagaattaaaatttgattgtctagaagataaattatcagttttacctactttaaaattatttatcatagcataacgttctgacgtagctatataaatataaccatttttatttttttctttaacattatttataaaatttttcatattcatattaaatctttgtaaattattattttcttcttttaattttaataattctttatttttaatatcttctatttcttttaatttatattttgatatataagtagaatattcaaataatattttttctatttttatataatattttctaatcattttagaattattgttgttcatcatcataattgattctttgaaatcatcaactgataatattaaccatgttttttgaactaacgcatgcttatcatataattttaattcactttttaatatattatatttatttaatatattttcatcatattttattatattatattcaatattattcttttttaaaaatgatctataatctttcttatattgtatataattgtctaaattataagtggggaaacatttccccacttggaaattataaataaaatttaaaatttcattagttattacaacatttttcttattaaataacggaaaccatatatctttaaaccaagaacctagttctatatcataattattatacgttataaaggttgatacatccattaatgtgttattttctatatatttaattaattctttttcattatcacattcattaaatatttttttaagtgatctaagtgaataatatctatcttcattatcttcaaaatattcttcataattagtataatttaatgcagtaaatatgtctttgacgctgtatttattattttcgattttaatattataattcattattatttttattataaaaattaatatttcaatcatagtttagatatatttaatatattatcgttaattttttatcattataatttataggtgttttactatttttccactcaaataattcctttacatattcccataatttatttctattaatattatcaatatttaattcattcaataattgaattcttgatatttttaaattattattttttatatattcatctagaatattagttattttttctttaatttcattcaatttaatagaatcatcatctatatttattttaataggaattacaggttttaaattatacatttctgataatctattttttattaaattgttaatataatcatatggttcattaatatttttaattactaaattaataatatctaataaatatgtataatgtattataaatatttcttttctttttttatctctaaaatcttctaataaatcgtgaattaaattttctgttttactcatattatatactttttgatagaaacatatataaaattcatcttgatctatgtgtgatgaattaaaatttgattgtctagaagataaattatcagtcttgcctactttaaaattatttatcgaagcatatcttttagaagtagcaatatatatataaccatttttatttttttctttaacattatttataaaatttttcatattcatattaaatctttgtaaattattattttcttcttttaattttaataattctttatttttaacattattattgtaattattaatatattttgtatatttatacaataatccttctataaataaataatattctctaatataatgtgctgatttagtatttaatctcataattaataatttaaaattttcaacagataatattatccatctttttcttaatatattattaggtgtaataaatttgatttcattttttaattttttattggttaatacatattcgtgtttataatcaatttcaataaatttaatattataattattcaaagaatctattaaatttttcttataacctttaaacatttcaggggggggctggctcccctctggaaaataatatataaaagtgagaatatcattagttattaacacatctttttcttcaaataaaggataccatatatctttaaaccaagaacctaacttaaaatcataatcattattagtaataaaagtaaatatatctacgaatgtattatcatttaaaaatttaattaaatttttttcatattcattttcattaaatatttttttaagtgatctaagtgaataatatctatcttcattatcttcaaaatattcttcataattagtataatttaatgcagtaaatatgtctttaacgttatatttactatcatatatattaattgtaaaattattataatttatagaattcattattattttttataattaaaattcaatgtgaaattacctaaaacaataacgatattaaatattccttttattatttggtatgtattttatctttaaataatcaaatatatcttcttctttagttataggtaattctacattatctttttttaatgaatattgatttaatatcatattttcagatttagctatattacgcataaaaatattaaattttttagaacctgtaaaatgcataatagcagtatatttttctttgttattaactttatttatttcaagaataaattttttaccttgccataaaaatacgccagaaaatatattattaccttttctaattatatacattaattttgctattttttttaattcttctaaaaatttatctatagtaaaatctataattaatatatcaatatctttagaataatctaaacctctagcatatgatcctaatatataccattcacattcactacttaaatttatattttgtttcaaatcatttataaaatttctactaactggttccatatctttgatatattcgattattttaatttcgtgaattgttaatattcccatattgataatattatcttttttttctattaaatcatttatattttttatatttaattttaataaactttgtgcttttttaggacctataaataatattgaagttaaaattttaatatatttatacgaagaattattttctaaattaatgagtttttcaaccttattagtacttaataattcatatattatatctgaaattgatgttcctattgattttaaatttttatatttttgaattatattttctttagattcgtttaatataaatttattatttacatttttatatttaaaaattatcacaggagtattttgtataacataggcggcatttaaaaatgctttatattttatttcattaagtatattatatatatctgcaaatttatttaatactagtaatattttatgcttattaatcatcgacataaaattatcaatattcatattttgtttaatatctaaatatattttcatttcatccattatagattgatcaggaacttcatttcttctttctaatatacatggaatattatacaacgttgcatatgtttttaaaatatgtaatgagctaagatcgtctttataatttttaaaaatgtttccttttccaatagcttcgtgtggtttatacgaagataatggcaaaccacacgaatcattaagatgaattaatataattttatctaatcctattaacaaatcaaattttgcaagataatttatcatacctttaactgtattaatattgtaaaatgtaacaaatatgtgtgaagtgtctatacaaaattttattctttttttagcattagaatctaaattatcatataatattttaaaatcttctgttttagcacccaaatgtcttatatcatttgtagtttcaaatattatatgattaaagtagttattatctaatatattatccaaaactttacaaaatttatttaattcatttgcgacatattttaatgattcttcttgatttttattataatataatgacaaatgtacaacagttccagaattatttatttccatattttgtaaatataataattctttttttatatttcttaaagcaacactatttttatctttagctatattaccaacatatttagaatgaacaaatattgttctacctgtataagatttatttaaatattctgttgattgataactatgtggtgcaccgacaaaaaattgtaaaggacatttatatttatctaaatattctttaattgtatgaaaaccgatatatttattgtttaatatattatttttatcgatatcattcatcgtggttatatttaacaaatggaaaatttacatttattaaattaacattatgtttaatacaaaatctatcatgacaattatttacatgtggacagtatttattttttatataaaataatttattatgatgtggaaaaaaatgatctgaaatagaacacgtaggaatataattatctacaacatttccattatttatatttttattaaataaatcaaatgtcgtaaatacatcattttcataatatattttcattataataaaatctaaatatattatacaaccaaaacatttgtaaggtttatctatttcttttaatgaacaatatgtgtgattatcaaaacaattatttatatataattgacattcgttattaaaaataatatttaatccgtttatactaaaataccataccatttaatttaaatgtatttaataataatataataaaaagttaatatatttcttatttaatacgaatatattatattataattattttctaataatattgtgttcagatatattttttaaatatggtataaatttttctatatttttaagtccgtgtattgaaggaggtattattggataatgattaggataagaccattcatcatcactgtcataataacaatcgatataataattaaaattaccaaatgctttaatatcactaaataatgctatcccagcatattcttccatcatatctattaaattaggagaaatcacaactctacctatatcagtattattattaattattaaaaccttaaaaatataaaatttacctatttttattttattagttaattttaaatcattaatattaagatttatttttgtatttatataaaatattataggtatattgttatatgataaaatatctttttcatatttatgaatatcaatatttctatttatatcatatttattattagaattagaatataatatttttttacactcatcattgttatcaaaacattttaaattatttatattattaaaataatattcatctaatatttttgatttttcgtaattataaacaaaattatcgtaaaaattatatattttaatagatttaatatttgaattatctctaggaatttcgccatctacataagtaccattcaatcctgtataatctctattattaattatttgttttatttttcttacatttatgttttcaatattactccacacatatccattattatattccataaacttatattttaattttgaatttattaatatataattatctacataaatatctgataatgttaaaatatataattttttattatttagaaataatatatctgcatccattataatatttataaattaaattttaattttcaaaaaacttatttaaaatagtatttttctacaaacttttgatttattaacattagatatttgttttatttttttatattttaaatattttttttttattggagaacataattttttatttaaaaataattcatctatatttgaatctgatttaatattatcattcatttttatatttgaaaatatgttagctaattctttactaatattttgtttctccatttaattatttattattatattttcaaaataactaatcattattattttctaaatttaaatatgtgtcatttattttaatatcagatataggagtattaacatttactgtaatagatccattcggaattgtcataactggattattacaattattatatcccttttttattgcatctaaacattctaatacacttattaaaactatatcgccttttctaaaaccaaagctattatcttctaatatatctccattatttgcatattcttcgcctttaaatataattccagatatttcatttggtgttttgccactaaatattcttaataatttatgacctatgtctgtatccattaattcattaaatatatttaaagatataaagttttcatcatctaatgtatttacattaatcttattaatagtttcatcaaaactatatggaatatcagcattatcacatattatttttctagtatttggatcttttaaaaaattaataaattcgtttactttgtctttatcatacatagggttttcattttctttaatattttctaaagcagataacatagtttgtattgtttctgaattatatttcgtagctcctgcttttatattataaatttctctttttaaacaatcattaattttattgatattattataggtaaactcattatcttttaatgtattatatttagataataataaaggacaaatattttttaaaattaattctattatattttttttcatatatattaatttattaatatttctttctttcttttttacatcatttaaaatttttatagtttctaaataatttattatatttttttttataaaataaaaaattatacatcgaaaaatagcaataaaatcttctttaattataaatattaatttttcactatgatcatataataaacaaaaatgtaaccttaataatttatcgtgtataaaatttttatattgatttggtatagacaaatcgttaaatgtattttttattttattaaaaatcattttataatcatttaaagataaattagataattcggtgtgtaaaaaattatataattcattatattttatttttaataatttaataatttcttcgctacttttattatctacatctatatgaaacgaacatttaaattcttcaaaattttcacattttggtatacataacttaatataagataatatagaatcaattatggaatttattatcttcatttattatattattattataataataattctaataaaaaaattatattttatcacttaacatgggaaaattttctaaatctgttttatttgttttaattatattttttttcatatattttaatataataattaatatttttataagtgaaaacacaaacataaatattaaaattatacacaaaactaccaaagctaatatttcattagattgattattataattttcgatagttgattcgtgattaaattctgcaaaatcattaaaagttatacgactattaataatatcttttaaagtaggtttatatccaaaatttggattaatattatttggttctattgtttttaataattcattaatattattttttgtaatagtatatatattattatttattttttcaatcccacctaatatattattatatatgcattgattgttagtattatcattacatgatataaatctttgttcattttcgcattttcctttttttataagtctagaagtataatatatttctgttgattcagtattataataaccattaaaagttttattttttatactaaaaattactggaattaattcatgacaaaagtcataatatttattataagatggtttatattcaattatatctacatctaaacatttttttactatatataaattcccaactacatttacagatatagatttatcgtttaataatgatgatatacaagaatatgcatttaccttgcatatagaatataatcttaatatcatcgaagatattttttcgcacatttcatgtatctgtgatttctctgtttgtattatatcactaatatattgtattttacttccataattatatatttctcttttgtgtctatgtaaatctaaaatactcaaaattttaatagaaaattcgtgttcgtttgtattaataaaattatttttatttaattcatatttcgatttactcacaattaaagatataggattatttaaataattaaatattatgtgcatattatcattatttataattatgtcaacgtcaattgcatcactatcattatattcatttttagcattattgtctatatcccatactaatacatctgaattacttacttgacaatattttgtataataattacaattatatgtattagcaatattacttaacatagtacctttgcgataatatactttaccaggttttaaatttatatattcttgtataactgtattataatgaaacgtataatgaacgcaaaaatgtttggcttttccatatttatatgaattatcatcttcgttatatattaatgttttatttttaaaaacgtgagttttattaacatttattatatcattatattctactatattatgatgaataatatattctgttttagcccaattgagatatatagaaggtggttctgtgcatataaaatcaatatttgtaaataatatagcattagttgaatatgatttttcatttaatgttcttaatataattttggctttgataggttcgatattattacaatttaatatatctggtaattgtaatacaacatctgaactttgtttatcacatataaattgagatttaatattatatattgtaaatataaatataaataatgtagtttttttaaacattttatataattatatatctcaatctcataaagtataatattaaatctttactttatttttcattattgtaaattatgggagcgtccgcaagtattaatactattgtgtctgatataactaatagagttgaaaattcattaattcaaacagcaaatgcctctgcacaagcaatatgtcgagtaacaattggaagtattagttttagatccacacagggatgtactatagaggtaagaaatttatgtagtgcgcaagctgtagcacaagttgacgctgtagtaaatgcaactattgatttttataataatttaacttttgaacaaaaacaagaagcacctacgtggtttacagtagcttatggaataaatactactgtaactactatcgaaaatgattttagaaatttagttgaacaaagatgtaaatctcaagctgttttagatagtagcataacagttgataatattttagttaatgattgtagagcaccaggaaatgaaatagttagatttacatttgttaattctggaacggctgctggacaatgtgcaatatctgctctattagatttacaagtagcgggttctaatcaagtaagtgctagtcaaagtcaaggtttaaatataggaaatataatattatatgtagcaatagcaattattgttattgcaatatcatatgttttaataaaattttttggtaataaaccaacaataaaacaacaaattagtttagaattagctaaaaatggagcagtgtctagtcaattaatacaattatcgagatatgtatctaaaatagatgatagagattgatatattttgaaaaaatataaataaagaaaaataaaaatggagaatataaataattatatcggggttgttaaaaatcaaaatttgcataaagatataaaaataaataatatatatattacaatattagaagatagtaaatattatttaacagtcgattattgcatagagaatgaaaatattttaaaatataatataaaatcatattttcaaaaaatttatttagaaaatttaaaaataaaaagttatgaaaagaaaatatattataatgataatattacaaatattttacattgtattaaatataaaatattaaaataaatatatgctttcgctcaaattattaaaattataattatatatgtatgatattaacttagattttaatttaattgttttcaagcatttataattttcatatattattgtattatttggaatataatttttgtgtatattattatttctgatatacatttccataattataaatatttgaataatatttttatttattaacatatttgtttttaataatgctatgaaattattattatatgatataactacaacatgattattattaaaccaatagttatattcctcaattgtgtatataaaaaataaatcttgcgtttttttatttaataattcgtaattaaaataatcagatttttttattaaatttttatttccgtatgtaatataagtatcatattcattaatatattttacattattaaattttatattagagttaaataatgcaattataatatcatttttttttgcatttttcattatttcgtcaattaaaaaataatgtaggtatttatttctataatctttatctatgcacaaaaatgttacatgtatacaatcataaatttttttatgcaaggatattgttttttttattccagatatcgtacccgctattttatcttcgttatataataatatattatattcttttttagaaaaaggatttaataataaccactttatagtatctaaattaaatttataattataatttttatataaaaaagaataataatctaaaatattattttcgtctaaatattttatattaaaattatctttacaataattattattatatggtttgtgtggttctattgtatttataatattatctattgaatcgtaatttaatttacatattgatttattaatccaatatgacatttattaattatattaaatattaaaatttatatttttaattaatatttatattttaaacatataatattattaatatagataatttcatattattaaataaaaaattttacaataaatgtgaaaaaaaatataagcaaataaataatgacaacttttaaatatactttgttagataatagcacaatagatgctattccaatagttattgattctattggaaatgataacgaaaatagtgtaaaaagtcctaaattaggcggaactaaattcaatgtgtgttcgacatgcaatttaacaagagaaaatggcgacatgggtcatccaggaagaactcctttaagagatatgtgtattgtaaaatctggttgtattaaaaatgttttggatacactaaatacattaaaattatgtaatagttgttttatgataaaaaataatacaatattttcagaaataattgaaaaatataatagcgaatataatattaatttaaaaaaagaaatattatcattattaaaaaacaatcgccaaggtggggtaaaatgtaataatgaaaattgtcaaaatataacaggaacatataaatataatcaaaaaaaatcatatttttacgtaaaaaaacaaaaagatgaaatcattcttaataaaacagtttatactatgttacttggaattcctgatataatttataaatgtgttactgtaccatacgcagattctcaattacaaccttataaagcattttacgctaataatattataattcctgtattaccatctagacctccaaattattttgataataaagaatctcatgttatgacaacaaaattgggtcaattagttggcacatcacaaaaatctagagatgaaagtgaagttcaaaaaatatataatgatattgataatgttaaaccaaattctccatataaaactagtaacatgttagttacgttaaatatacaagttggtggtaacaaaaaaggaagtatagttagatctaatataatggctagaagagccgataacacagctagatgtgtagctggtccaactatggacaaaataggatatatatatataccaaaaatagtggctaagacattaacatcatcaatatattataatagatttactgaaaatatgattaaagatatgttagttaatgataataacaaaattaaatatatattattatatagatatgatcaattaaaacccacaacattattaaaaataaaaccacaatctagactcaataatttattaaaaatgaaatatggagatagaatagaagttgaattagaagataatgatgtaatattatttagtagacaaccatctttacataaatttaatattcaggcaggtatatgtaaaatatgggataataatacaatagcaacacctacgccgatagcaaattctatgaatttagattatgatggtgatgaaatgaatgtatataaattaaaatcatctgtgtcagtagaatcattatttactatgttatctgttaatatgattaaaaataattataatttttcgccaatatttgggttaattcaagatcaaataatatcagtacatatgatatataatattaaagaattttctctacaagatgttatttatattttaggagaatatagttattatataagagatataaataaaaaaacatattctggaaaagaattattatcattattatttccagataatcttacatatgaaggtatgtttgataatggtaaaattacattatctaatatatcatctaaacaagttgtagctcagtcatatgaatcattttcaaatattctatctcaattaaaaaataatatttatgctgtgtattttatagatgtaatattatatgtagctagaaattttataaatttgtatagttttagcgtttcgttaaaagatattattccagatatatattttattgacgatgttcaagaatacattaataattgttgtaaagttatacaatatgttgcgctacaatattatattaaaaaagatcatataataaaattaacttatgatgaaatggaaaatataagaatacaaaacggtaataatataatatctaatgttaaaaataaaataaataatctatttaaagatgagaaattaaatactataatgatgatgaaaaattcaggctataaaataacattagatgaattagtaacagtgttgggttgtactggacaacaaggaattgattcagatgatataccgaaacccggaattatgggaagagtatttgattcaacattacctggaagtttagacatagaatcattaggatatgtaaaatcatcaactataaaaggtttaaaattcgaagaattggcatttcatacaaaatacaattcaattaaaaaaatattaaaaataacatgcgagacatcatcggcaggtagtattggtagaaaattagttaaatttatggaaggtgttaaagtagatcatttgggtagatccgtattaaataatgatattatatggtataatacaaatcatattaaaatgacaggtggtgatatatctaaagtagaaatattaactcctagtttagaaatggtaaattacacacttataaaagaaatatataacgaaaataaaaaatatttattaactaattttaatactgaaataaataaagaatttatttttccaattaatataaaattagagattcaatcattttataataaaaaatcaactcctatatctgatatagatgcattaaaattaattgatgaatttatagaatatgtctatattaatatatatttttacaacattacaatagattggtttaaatatattttatatacatatctagatagaaatacagtagaaaaatataataaaaaatattctaaagaattattaaattatataataaataaaattaaattaaaattactaaattcattaaatccaggttatcctattggattagaatacgcaaataatattcaagaaaaatttacacaacaatcattatcgtcttttcacactactaaaaaatcaggaacagcatcaacccaattaggattttcggattttaaagatactgtagaattgagtaaaaaaaataaaagagatattgtaattgcttttacaacacacagatataaattagaagatattaagaagcaaatggaatacttgtgtttaaagaattttaatccaaaaataaatatcatagaagaaactgaatctgatatggtaataagtgtaagtataaaaaaatactatattaatgacaaaatatctttatatcattacttacaaatgtatatagaatatttagaaaataataaaattattaaaggctattggataactatgaaattaaaagataatgatataacagtgatatttggagttaaaattaaaactccttataatataaataaaatatatatgataaaaagtataccagtttcggtttctaaaggtaaaataagtaacataaatttagagatagaagatgttaaaatgtataataataatttggaagaacaaaatggttatagattaaaattctatattgatagtgtcacagattttattaattttgatacgagagatgtttatctggaattaggtccgtggtttacgtataattcgtttggcatacaatttgctgaatattctattagacgtagattagtttcgtctacaaaagaaaaaagtatggaaatatgttatataatattatcgaaattgatgtgtttatcttccgaaatgtataatataaaaagaataagagagggtaaacaaaatgttataaaatcagcaatacatggtagttcggatgctataacaacagctgcatataataatataatagatccaaacaatgatatatattctcaaatattatcaagtcaaattatgaaattaggacatggatattatgattgttatttaaatttaaatagatatgattctattaacataaattctgtcaccgaacaagatataaatataacaagtgaaataattgaaaatttctaattatgaaaaataataataaaatataaataaaaatgattaacattaaacaatattttttgtttttgattgttataatacacataataaccaatatattttttaaacaactaataattatatatgagcccgtatattataatacaaattattatgatgtattatcaatatcaaaatatattatagtatttaatattattatagatgatataattacaatattatgttttatgattaacaaaaaagtattttatgaatatatcgaatatcactctatatttgttatatttcctttaatagtaatatttatcaatcgcagtgatataattttatataatatattatttgcttacattttatctattttatattttataataacatttgaaataaattatgttattatacaaaaaaataatattttaaaacttaatacacaaattataaaataataaatgaatatatttggattaatagtttcttcattatcattattatcagctatagtggttattatatttaatatatttagaattagatttttaatattaacaaaattaatattatatgttatattaataggatcaattataataactatttttctttttacattataagcgattgttccccaattattaaaaatataatactgattgtatatcttatttatttttcatactgaaaaaatatttttcttatgttctacaatgtcattatcaagtttatattttttatatttttttttatttttcttttcaataattttattatcgatgtaattatataaattttcactatttttattatcatctaatgtaaaatcttcagtagtattaacctcttcaatttcttctttaataaaagattcgttattttcaatttcaatatcaatatcttcgttgttattttctgtttcgttatatatatatctaactacccaataagaatctatttcatcataatttagtttattaattacttcacaatcaattaatttataattgtccaatgtatatttattaaatttatccataataaattgaatgttttgtacatctggataaggtattttttcccatgaaaaagttttatttttaacactcaaatataaagatatatattcttcggaatcatcgtttaaaatagattttctaaactctaaatcagtaattcttacatctgacatataagaatcatttttaatataatcattaattaattctttaaattttatatatttatccatatttatatatataaaaataattagtttatattttgaaaaaatataataaatataataaatataaaaaaatggataatattgatttatattgttacgaagtattaaataaaaaagataaaataagaaacaaagaaaatatagtacctaaaggatattattctcaaatacaagaacaagttcctgataattatattaaatctaataaaatattaaaagaaaatacaagtaataatataatgaggtagtatcggtatagtaatattgaatcttacaacgaatctaactaaaacttaaaataaatgttaataatttaggaatctcataatgaatcttgtatttaaactgaatcatcatttcgaataaatttatataacattgctatttttttttatatttgtgtttgtaattatatataatataatctatataataatatttatttattgttaaatacaataacatattttatatataatatattatttatatattatacagtattttgattttttatattaatttttcacagacagttaaattatgaataaaaaatatcaatatttgggttttactttagataacaaaattccgagtatacaaaataataaaatatatattagagataaggattataatataagtaattataaattaataaattttatatatgataattcagatattataatatctgaacaatctactatatattcgaaagaaaatttattatatggtgaatatatttttaatcaaaataaagaatatgtgggtattattaccaacaaattagaaaatagatatcctatttcacaagaaaatgataatattataagaataaataatgttaataaagttaatataaagaatcaacaatttcctgtattatattgtgataaagaatttccaaataataatatattaatacaatatttaaaattaacaccacaaaaaacaaaaagagaagtaacgatatttaaattatttatgaaaacaattataataattcacgaaaatgaaagaaatataggcgatatgttatttaataatccttgtatatctgaatatatgtattatgataataatatatcttttaattaattattttagctatattattaatagataattttatatcattttcattttgtttaataacattatctatgatatgtataataaataatttataattgtcgatataatttatatattcagtattatcttcaacattaatattaaagaaaatcaaattaagaaaattattattatcaacgttataattataatatgtattaactatgtgtgtaatcagagttatatgtcctaatatagatattatgttactttctatcattaatgcatattttagttttattaaatatatattactatatatttttttatctatatctattaatttatcaaaaaaatctacattaaaattaatttttaatatattcattatatctaaatgtaatttatacattttattaaaattttttaatatttttttatttttaattttttttttatattttttatatatattatcgaaataaaaaatattattattatgcttatccatttacttgagtatttatgtaattccaaaatgctataaattcttcttgactacttccgatcattctaattattatatctatatattgatcgttagtatgtctatatatgggagtaatttgtaataaattataatatgttctaaatttatcaagatcgacatcaccatcagttgttatagaatcaaatgcttctcttaatttttcatcagttatattaatacctattattggaacaaattcatcaaaacttaacgtattgttattattcaaatcatatgtggcaattaacgcacgaacatcagataaatttatagttggatcaataacaattaaaaaatttagtaattcttctgccgtaatttcaccattaccacttgtgttaataagatcaaaaatatatctaatattatcgattggtgatgttattctagataatgtagatgttgtattatttataatttgtaaacttctttccatttaatatttaataattatttatatatttatacatattacatttagattcacaaaattttaatattcttaatctatatataaaattattaatatattcaatatatcctaacaaattatctaatatttcatcatcattttcatctattaaatttaaaatttttaaatatttttcacgacttaatttattatattttattataatttttgaaataattttatatttattgatatacattattatataattattaataataattaatataatactataaaaattcaattattaaaaaaaaaaaagtgaaataatataaaataattataaatggacaataatacaattactaaacatattggctataatactttacaagttgttacagaaatttctattcaattagaaagcaaacaaataaataataatattagacaagaaattgtatcaaatataaaaaataatataataaataaaactagcggtgttaattatattttatcagttgattatcaatcaatattaaataatgaattaccattattaagattaaataatgtatatacacaagaattagttgttaaattacccgtaacatatctatattttacaaaaaatcaaataataaaagcttatttgacaattattgaaggagataatccacatgtagttgcatataacaaatatatatattgtaatataattttagatcataatttcactataaatatgtcagaaaaattattaatatttaagaacaaagaatataaaaatagagatgaatgttatgtaaaaataatcgatatatatagttcagaaaaaaataataaaataccatgcaaaggtattttgcaagacgaagaaatataaattaatacatatattttatactatagatttattaattatttgaaaaatattatatttgtctaaacataacgatatattatttatttttatcttatataataaaattataaatatttgtccgttttatttaaattttatatattttttgaaaatatactataaaataaaaatgaataacatttcatataaaaattttatcgaaaatataccagaaaaatggttagatgtgatagataaaaaacaattagaatatgctcatcataaattaaaaaatgaatctattattaaaccatctataaataatatatttaaatgttttaaatattttaatcccgatcaagttaaagtaattattttaggtcaggatccttatcctactgttggaatggctgatggtttagcattttcctgttctaataatagtaattatattcctaaatctttacaaaacataataaaagaaatattaaaacaaaataaaaaatatgatatgatgaaaaatattaatatgaattatattaatgtaaatctagaatttttagcgaaacaacaaattttattatttaatacgatattgacagttggtgatgagccaatgtcacacaaacatatttgggaatcattttcaaattctattattaaaaaattatcattaattaataataatatagtatttatattatttggtgcaaaagctcataataaaatttattttatcgaaaataaaaaaaatcattgtattatcaaaacaagtcatccttctaatttatcttgttataaagatggatatgataaatatgttccttttaataattcagattgttttaatatttgtaacgaatatcttataaaaaataatataaaaccgatagattggttatctgaattaataaaaaataattaacatttttattttttaaaaaatattaaaattgatataataataactatcggataaaaaaaacttacaaataaatttggtatgtcaaatgacgttaaattaactataatttgagataatgaatatataggatttatgttactagcacattcgtttgttacagttaaatttccattgtcatttaatactatatctgtaacactaatttcacacactgtaatattacaatattgttgttcactttttattaaactagtaatatagttttcattatttctacacgcagaataccaacaaaaatatggcgcatatgatgattttgaaaatacatcgatattatcattcactattaaacattgacattttatatcatctttattattattacaatattctatcattttattatcattttcataattacttaacatttattaataatataattgttatgtagaactaaatatacatttacgtgatattttttatgaataaatggaagttcttaataaatattatagtgataataaacctatattagttgaggagtgcgatgttatgaaagttgatacaataattcctaataaaaatagtattattaatttagaaaattcgatatttaacggtcattcaatttttaaaaataaagtaaaattcgataatgaagttgaaattgatggtgaaattatttttaataatgccaatacaataaaaaatattatgactgagataaataagttgggaccagtaactcagttacagcaatctatagatgcagttaatatcgaagatattaacaatccttttgtattattttacagtagaaatgatttaataccatctaatgaacaacatcttattattcctccaaatatttctgctgaacattgtatattttatttagttgttatgtttaataatggcatgaattattgtaaaattaagttttattataaagtaggagcaaaatcaccatttgaagttttatccaaagaatatattaattgtgatgaaaataaagcatctataaaatataatgatggtagtttaaaaattgaatttaaatataataaagcagttgtgaataatattaaaattaaagtatatcattctgatatttaattacgtgatgtaaaatctaatatttaaatggaaaattatgattttaaaattgataaatatactcatataggaaatcgtagttataacgatgattatatatttataaaaaaaaatataaattatatcatgtttgtaataattgacggacacggaggttcagaatgttctaaaatatttataaaattatttaataaaaattttaatccaaaaccatatgtagatattggattatatataaaaaatttatttataaaaattaataaaacaattttaaataataaaattacatctggagcatgtgtatctggtatttatattgataataataaaacaataatatttcaattaggagatacaaaaatatatttatataataacaataaattaacatatgaaacaatacaacatgatatatcaaataaatacgaaagaaataaattttttaaagattttatttattcagatattccaagattatttggaaagttaacagttacaagggcaataggaaattttgatttaaatataaaatatatacctaaaatagattatatttctaataatagttataataaaattattttatgcacagatggagtgtataaaaaaataaatataaatatcgatgatactgctaaagaaaatattaataaatgtttaaaaaatcctcctaatgataatatgactatgatgattataaatttatcaaatatattacatttaataaataaaaacatataatgttgattaattgtatgagtaatattaatttacctgttactaataatatagactttataggagatattgcaataatatcaaatataacacatattcataataaaaatttaattaagatattttttaaaaaatttgacgattttaaagaaataatttttgtaccaggtaatatagatattttatttgataatgatatagtaataaataatgaatatatacacaattatcattatagaaaaatattaagaaatggtttagaaacaatagatgataacgaattagatatcataattttaagagatgaattgtatgaatttgatcatttcgacgatataataaaaatatatggccaaagttattccgaagataaaaaatataaatattctaatattaataaaaatgaaggaatatcacatttaaaatcatcaaaagatataataaattatagaaataatataccaaaatgtgatattttaataacatctagttctccttttggtgatgataatgcgtgtggatatttattatcaaaagttataaatattaaaccaaaatatcatatttttaatggcttaacacaatatactcatccaagtattgttaactataatgatattatttttgttaatagtaatatatataataataaaaaaaaatcatatattattaattattaatttttaaatataaatttaataaattttcagtaaatacaaataataatttaaaaataacattattatctatatgttctcttatttttattattgttttatttttattattatgtattttataaatttcatttttaacattaataaaattttcgtcattaataatattttgtaaataataagataaatcatcaattaaaatattaatattattaacattctcatcattttttatattaatatatatgtttttaaattcattaataatttcttgtgatatatttaatatagaatctatttgatctgattcattttcattaattttattataaatattatttatagcgtcattagtggttttattaataattatattctgcgataaatcaattatttttttaatttttttaataatatctacaaaattatcatttttaataaatttatataaatttgcatataatgtaaacatttcatcttcagataataaatttattatttcgatagaataatttaaaaatatatatttcttaaatggaaatattacatttctataaataatattcaaataatataatatattattatatatattattatatatattattaatatcaataatcatgattagtgattgttttatttttaatatattatttcaaaattattaaatattttttaatataaatggaaaaagaacaaaatgttgctgatgatgtcgaagatattgatgataaagaatatgatgaaatattaaaaaatattgaagatgagaaaaatgaattaaaaaaaaaagaatacacagaaggattattaagattaatttttaaaaatattaaagaaaatgtcgataaaaatactgaaaatgaaaataatgattttgaaacagagattgacgttgataaacaaactgaagttcaaggataataaatgatatcattgtttaatattttaataatatttatattattatttatgattatttttatatcatattataattctgtatatataaattttataagcaatcataaaaattataatattaataatatatattttatagataattttgatagatataatagtataataatggaaaatttggacgaaagatgtataaatataataaaatataattcatattattcattagaaaatataataatattatcacaagtttataaatctaaatgttctattttttatttagattcggatataaaacaatatattaatgatgatgtattacaaaatataactattattaactatggaattataggagatttatttaattatattaataaaataataattaataattatttttttatagataaaattatttataaaaaatatggaatgttacaaaatataataacatctaatttatctattttacctgatatattaatatatgataataattattattatataagttattatacactgataacaatggcaatgttaact

SEQ ID NO: 27 - DNA, 32392 bp, Amsacta moorei entomopoxvirus
tttgataattctgatattttatcaaaaaatatcgatttaaatacatataataatataataaatacttcaagaataattaaaaaaatagcttctaatatagatatggaatattttgaatatataattagaaaatctgattttttatttaaagataatacaattaacttaataagaagaaaagattttatcggatataaaactaataatatgtcgttaataaataataaaatattattatataaaaacatagcaattataaccaattatattaaaaatgaaaaatattttggtaattgtataataataaaaaaacattatattgactatataaataaattaacttccggatgtttatacatcgaaaataataattatgatatagaatataaatttaataaaaatatatataaaaataatattattttatataataattatatattaaaaaaagaaaataaaattataaatattaataatgatatattattatataagtataatataattaataaattaaatattgattatgatataaatataaataaaaatatagataatagaattgttagtaataatcatattataacaatagataaaaaatatatatatgataaaaatataaaaatatataattgtaataatatatcaatatatgataatatatatggtaatattttttataaatttgataagatatctaatatttatataaattttattaatactaatatatataattattattatatatcgataattaatccaaaaaatattattatagaatataatattaattaaattttttattattataatctatatttaatatattattactaaacatttttataaaatatgatattatattattacatatttcagaaaataattgttcgtcgggtatataatctattacatctatttcgttatcataatgttgaattaatttactctttttataattcaataaaaataaatatatttctaattgaactttttcatatataggaatgtatttgaatagtctttttcttcgatttttgctttcaattaatacatcgttaataattccatcaattttaccacacactattatatttatttttttattattataatcaaaagataataattttttgatataatatttatttctatttgttatatttacattatattttttctcatataaatctatattataatcttcttttatacatcctctttttaaagatatatcttctgctaaactattttttaatttattatcagatatcacgttaataacagaattactcccttcttctgttttactatatactgatttgaatataatattgcttattttattagttagatctgtcgaatcactattatccacatcacttatttcatttaataatttatttttttctatttcattataattatctattattgtagtatatttttttttagtattattgttaatataattattaattaaaccaggattatatttatttaaaatctctaatttttcttcatcatcaacatatatgttatgatctgaaaaatatgatagtttagacgcaattagtaatatatccatttatattattattattaattaatatttaaaatactattaatgattatgtattaattattttatctaattgagattcaaattctttacacaacaacggattcaattcagttttttctgataataatttcaataacgtttgttctgtcattctaacagatttatataaaaaatctgttatagatttaattgttagtttattataactttcatcgggcaaaaacttaataatagtataaatattttcaattaattctttttccatttatattataaatctttatatagatattttgaaaaaatatatatttaatcaatacattatcatattataaatatatatagcatacatatataatataacaatgtttattgacaatttaaacaataatatgtattatttaataacacctattgttagaatattaatacatacaaacaataattcaaataaaatattaaaaacaaaacctgtatcagataatgattacgaaatattaaaatatagtagttttgttgaagataacactttaataattaatgaaaattatataaattcttttacttgttgtaaatataaaatttataaaattactaataaaaataataatggtatttcttacaaaaacttacctacattgtattgtagtaatattacttgtttaaataataagttacaaaatataataaataaataacattaattgtagacaataatagaatctcatataaaattattgatcccatcgtaatgtctcaaataaatattttctaagattttatcatttttattaagaatagtatttctagaataatagatagattttttatttcttggtattaaaaatgacataaaaataaataatatatatatagataaaatagttattaatattattatataatctatcatttttatattaaacaataattgcaatgataattctggttttctattatctaattttagtaatgcatctgatatatattttattccacaattagcatccgcagaacccgcatttaaaaataagaaatcagtaggaaaattagaataacaatcatttatttctatagtaccgatatttatactattgtccactactgcacttgctctacaattatttatgaatccagtatcattttcatttattatatcatctgtggatattcctaatatattttctatttgtgtgcgtctgtcttctggtaatagtaacatagtttctcctaaactttgtaataataatgtaaaactagttatttcattactaacacatttattacttaaaactatattacaattattaatattacttgttcttatttcatttatatttatattacaattaatatttgttgtactagatattctatttaatttatcgataaatctagtatatacgtcattaaatatagttctacctatattaatactactatttctggtttgtaattgcgattcattcatattaatatatttaaattgaaataatatatattattttaaaaatggatatttctgaatatacaaatgctatatatgataaattaatcgaattaattatagattatattaataatataaaaaatgaattaatagaatatatagataagaaattttttttcatacaagaaaaattcgaagaaaataatatatctaaaataaaaaattatccagattatataataggaaatgatattaatattattaatacaaatattacattatttataccaaaaagaatcgatactagatataaaataaataatataatatatataccatatgaagaaataatagaattatctaatttattaaaaatatataataattattataatgtaaaaataaaaaatatatatttagaaaagatagaaaatattattattttaaatgatccgttaatatatatttctttattaaaatcactattaccatctaacgaatatgatattttaacacataatataaataatttaaaaatataataaattatttatatatatttctctttctatataatatcctctatttttttcgaaaatatttatagcaacataaggtggaattttaaatttatatattaagtatttacaaaccatatatccagttctattaatgccatgagtacaatgtattcctattaaatattttaattcaatatatttatcaataatattaaaaaatttatttattttatcatctgttggtaaagattgtgcttttattggtatttttatatattctatacctaatttattaagatcagatggattataacatgtttctgaatatctaaaatctattacaatttttaaattaggaaaagtatttattaatttacatatatcccattcagtaccattgcacggaagtttgaaacatattgtatttatacactttattatagttccgtgtgcaaaataattattccatttataaggtaacatattaaatatttgattatatttaaatatttattataatagttatgatgtattgaattttttttttcatagaataaataaatcatattaattaaatttatatatgttataaaatgacaatatatttttaaattttgtaataaaatattaataaatgcgaattgagtatataaacgaagatttttcaacaacagatttaaattataacattatatcatttatttctagtgattttgtattatgtaaagataaatgcctaatatatattaaaaaaaaatataattccatcaaagaattaaaaaaacaaaagaaaaaaagtggtgaagtagcatatatatataaaaataataaatatataatttatattattattgcagattatatagaaagtaaagtaaatatattaaatattctaagagcattggataatttaaaaattattttagaaaaattaaaaataactgatattatgacttctagatcacatattgaagatgtgtacgaaactgataaattatataaatatttaagagagataatgccagaagaattaaatttatatttattattatagtttatgtatgaaaaaaaatgactatgataacaaatgaacgaagataattatataattttggcaacaatcgtaacatttatatacattattgaatgcatgattaaagttatgtatttattattagtttttatatataatatgtatagaattgttatacaagttatacaagttatacatataacttaatataattatattaatattattataataaatatggaaaattatcatattattatattaacaattaaaagaaattctgacagattacaaaaactagaaaatatattatcttgtcaaaatttattatataataaagattatagtgtattttatggaatagattataaaaatataaataaaaataatttaaaaaatatatgtaaaaaaggatttaaaaacacatgtccttattcaactttagcatgtgcgtcatcacatattctattatggaaatatatatcaaaattaaaagataaatataaatatattataatattagaagatgatacatatataaatgtatcagagtataataaacatacaaatacagttgaagaattattaaaaaataatagtatagtatttttatattctgattgttatataatgggaactaccatcaaatcaaccaacaatgatacaaaaataacatataatccaaagtttcacgtttcgatgggttgttattgtataacaccaatcactgctactaaattatattatttctatataaaatctagagtatggttccacatagattttcaattaaattttgatatacataatatatcattaaatagatatatttatatagctgctaatgtatgtaatcaatatgaaggaaataaatcatctatgggtttaaaacataataatataatgttaatacctatagaaaatacaaaattaatgagaataatatcgactcctattataagagttaatgaagctgaaatagatttttatataataataatgttaatctcacttatcgctagtttatatttctttggttttaatatttctgccttaatatttttattatttatagtagtagatgttgcggagaatgcaaaaaaataattatatgataaatgatattattgttttttgttgtatatttttttattgtgattgttaatattatattttatagtattttaaatagattatatttagataaattaatttttgaaaatgcaaaaaatcaattaagaactaccgtaagttgtataaatgatcattggtttgttgttcgaagaaatacaagatttttagatttattagctgttaaaagagattcagaatatttaaattgtaatactaatccaatatccagtgatatattagaatcgtgtggtttaaatggtagatttaataatagatcagaatattgttcacaagctttgttagaattaatgtttactttataaaaaattttatgaaattttatacaaattatggataggtattttatatttatgtattgtattaaatatggatgttaatatttcagaatatgttgacatgagtggttataaaaaaataataacacataacaatgaatttaaattgagaaagtattcttcatcagatgatatagataaagcactaatacttaataatttaattaaatcattatcatcacacacatatataagtattatagatattaatgaacaaaaatcacaagataataattcaaatatatgtaagaataaatgcaatatatgctgtaaaaaaaataacattaaaaaaaatcaaaacataataaaacgttttttaaacataatattaaaacattaattaacataaggtaaaatttcaagctttaatttaaggatctcagtcaaattacaataataaatttattctatatataatatagaataaattaatatatataaataataataaaattataattatagtaaaaaatataaatatatatgatttttttattttgtcaattttatctaagttttttaatttttttattatacatttactacataatttattttttctaatatattttttaataaatttatttttattaataagtattttaaataaatcattttctaagtcaaaatccatatttatataattatattttgaaaaataatatataataataaaaaatcaaaaatgttattttttaataataattatttattagaaaataacattttacatgaaccatataatattattaaatatgattttcctatatttaaattatataataataatatatgtgagttaaatttatttatatctgaacgagaaaatattagtttagaaatagttaaaaatatagatatgacaaatgattttaaattatttttaaaacatatattaagaaatataaaatgtataataattcatggaataaataatataaaggatattatagaatgtttgaataatgttgaatttataaaattagaatctatcaaaaaatattatatagatttaaatatatttaataatttagaaaaaagagaaaatttaaaatatttattaatagataattataatattataaattcagataatatagaaaaatttaataatctattatatcttgaagtaaaaaattcatatattgaagatgataaaatgttattatatgttaataaaaatttacaatttttaaaaatatatgaatctaaattagaattatcctatattgaagaatttataaatttaaaatatataagtgtgtgggacgaaaaaacttatataaatagtaaatatttaaaaaatatgtataatttaaactatattgaaatttttaatattattaatattaatggtttgataaacatatatgatttaaaatttttaagaactaatttaaataataaatttgttgatataaaattattaaattttctacacaataccgaatgtttagacataatatgtaataaaaatacaattataaaatcatttgaatatttaactaaattaataaaattatctatatattattacaataaaattaatagtataatgtataatttaaattcatcgaatttacaaatattaaatatttgtactaataattatattgattttaaattatttaaaaacttgttaaatataaaatatatgaaattaataaatataaataaaaaaaataaaatacgttttgatgtaaataatatattaaagtttaaaagtttattatcattaaaaattgaaaatatgcatatagataatattgaaaaaatcagtaattttaatactattgaagtattacacttaaataatattgatatagtaaatataaattttatagaaaataatttaaatttaatcgaattaaatttagataataattatataaataatataaattctttaaaatgtttaaaaaaaataaaaaaattatcattaaaaacaaacaatattattgatataaaaccattattatacttaaataatttaaattatattaatataaaatataataatataaaagatattaatattttaagatattttaaaaataatattgatttatatatagatgattattatattcatgataaattattcgaaaataaaaatttaaatttatttatttttgaaaaataatattatttattaatatttattatataatatataaaatggatactttaccatccgaattattatttaaaatatttaataatttagatataattgatttatataatttgtataatattgatttttatacagatgtaatatataaaataataataaaaaaaaataaaaatgaatggaaaaaattatacaaaaattatatactaacagataaatttatatatgaatataaacattatatagattggtttgatttatcatattattctacattaaatgaatattttattataaaatataaaaaaaatataaattggataaatatttcagaaacacaaattttatctgaaaattttataagattatataaaaataaagtatattggaataatatatcaaaatatcagaaattatcagaaaaatttatattagaatttaagaactatgttaattggaattatatatttaaatatcaaaaattgacaaataaatttataagattaaatatatttcaaaataaatattattcatatataataaaaaaaaatgaatcatttatatttgaaccgaacttagaaattttatataaaaaatacaatatgcgttatatatatttaaaatatacaagtttaataaaatataaaaatataactaattttagggataataatcaaacatcatttttataattacatactataaggcactacatatttactttttttttcattcataatatttattttataaataatgaaagctatatgtgttatgaccggaaaagttaatggaataatatattttatacaaaatattaaaggaggatctgtacacgtaaaaggaaaaatagttggattatctaaaggattacacggatttcatgttcatgaatatggtgatgtgagtaatggttgtacatcagcaggagaacattttaatccatataatagacaacatggagatattagtgataaaatacatcgtcatgttggtgattttggtaatgtgtatgcagacgaaaatggcgttgctaatattgattttcacgatgatattatatcattgtgtggaacaaataatataataggaagaacattagtagttcatgattcgcctgatgatttaggaaaaactgatcaccctttgagtaaaacaagtggtaattctggcggaagattaggttgtggtattattggtattgcaaaagattaattgaaggttatgtatttatttaataattctttagtgttatagtttccttttgttgatattattgtaataacattatttacattaaatttatcatttaatatttttcttaaatgtatttcagtttcatgtggtttatttgttattataaataaataaactagattattttcaaaattaataataggggtgtatattaatccgagatctcttaatatatctgaaatagtagccatatgtatataacaatttttattattacaattatatatgtataatgctgttatgaaatcatgatttgtatttatgtttatttttttattatttattaatatatttgtgttaaaattattttctacattaatattatttaataaattaaaataaggtttatattttacatattctatagcatcgtcaatatttaaaaatatattagaaaaaaagtaaattataaaatatttataataaaaatatattttaggataattataattattattaagcacacatatattattatctgatttatatatattttttgtattttttataattatttcattattttttatttcaaatttatcttcaataacattcataaaaaatatcatattattaacattaaaatttaatatttctatattattaatatttgttattttatttttattatttgtgtttattttactattaaataatgtttctgctttaaaaacaggaatattattaatatcaaattcattatttaaatatagttgattaggtatttgtaaaaaaaatttatttatatctgtagatgaatttataatataatcaatatatttattataataagaataatatttatttatattattactttttatattattataaatatttataatatcaaaatattcatttaatattacataatcatcaaattctaatttttttattttagaataatctatagtttcaaaataatttaatgatttatacatatattcacttgttaaaaaatatatagttaaagataataatttatcggataatatattgattaatactaatttattataataatatttatcaatcatatatccaattataacatattttaataaattaaatttaatagttatactataatatctattattttgatcgaaagaaaataaatatatactatttttaaaactagatttataaatgggtaatgttagaaatttattttttttatttttagttttattaaaaattattttatctaatcgcggatataatatattaaaaaaatctgtatttgaagtataaaatataatatctgacacattaatatccgacaatacatcattaataaatttaacatcagatattattttttgattattttcttctaaataaacatcatttgttaaaagatataatataggatttatttcatatttatctgttaataatctaaaatttttttcattatttaatattttattttcattttctaaaaatttataatttattatattttcatcaacaaaaataccatttttattaaataaacgaagtatcgcatcaattattttattatgtgatatattcattatattattataatatatattaatattatttgaatttgtatatccgttccaaaatgataattcacctgtatatactattagcattgatactaatatatgttctatgagatgtattaacttataattcttataatatattgataaattttgaccaaaattatttatagatatatttattaaattattattatcaaaattattattaataattcgcattccattttttaataattttatattcatttattatataaatggttataaatataattatctaaatattattatatagttaataatattttatttatagatttcatattaataataaataatggaaaatataatagattcttttatagatactaatcaattaatattaccaaataatattgataatataaacttgaatttaaatattatacataatatcgaagatgatagtattaataatatatataaagctttatacaaatataataaagttttaaaatatatagtaaaaaattataaaattgatttatatattttagatgtaaaattagctatagaatgcgtaaataataataaaatattatgcatcgattatgagaaagaaaaaataataaaaaatgaattaaagtgtacattttataaatataatccaaatgataaaaatttttgtatttttaaaacaattggcgaaatattcgatataattaataaaaagtaaaattttgaattattatacaaaaatataatattaacaccgacagtatattataataaaaatgtacaaactaaccgtattattcatagtattatttactataagatatatagaatgcgaaagtatagataaaatagtagataaatgtacaaaaaataattttattaaaacacattgcagtgttgatgtatatgataaatatataaatgtattaaattttaaatataactataataattatgatgaaatatacaaattaagaaatattatttacacattttctgaactacaaaaatataataatgttaaaaaatctaattttatagaatatatattatatcaagttaaacatttaatcgaatataatgaaatgatagacaatataaatattaatgaatttaatttattaattaaagaaatatgtgattcttatatatattttatagacgaatcaaataaaaacacattgatatatttacagataatgtttaataaattccctatatggttttctagtaacacagatgttattgacataattttaaaattttataaacgtattagaagtattaatatttttaataattataaaaataatattgataacagtacattacaaattgtaaaaactgcaatagaatatccaggatatattgtatcggaaaaattaatgaaagaaatattatattcaaactatctaatacatatacaccccgataattattataaatttagaaattattatatagaaattaataacgaatatataattcctaaaaatactttgataattaatataaaaaatataagtattactataaaatataataatttagacttaaaaactatcgaatatatcaataacgaatcagaagacatatatgataacataatacacattcatagaaatttatctgttaattttaattataataaaatatattattatatatttgatacaagaaaatattataatttatattatgaatctaatcatatcaaatctatatattacgatacatctatttctattaataataatatttgcatatatacacacaacgataataaattaattaaatattatagtcgtaatatacaacatgcattaatgacaagtattcataaaaatattaattatcctgattggtttattgatggtttatctttaaaatataaaaaatgtaacaaagattcctatttatatttaaaaaaccaaaattttacaatactagatacaataaattcaaatcgtaatattgatattgataattcgtattatagaggaaatgcacttattgagttcctagataaaaataatttaaaaataattaatgatataattttatctaataatactaataattggattgatgatattatggaacaaaaatttaaaaattcattgaataattatctaaattattgtagtaattattatataaataatgataattatttatacacaaatgaaataacagataaatatatagatagaattaataaatataaaatattcgataatgtgtgtaaaggtaatataattatagaacattatgatgatggcgaatctacatttatacttaataaagataatatatatatgttagatgatccacaatataataaatatatgtttaataacgaatcttttattaaaaatattaatagaaaaagaccaattattcataattatgattatgaatggttagataatagtttattaaatcatttaattaaaaatatttttaaaggttataaatattcaaaatatattattttaaataaattatattctaattatttgtttaattctacaatatattgcgataataaaattatacaagatataaaaataaattctacattatataaatacatatgttacgaaaataaaaattgtttaaatgtaaattcaaaaatatcaaatgaaaataatattaatattattaaaaataatttatgtatatacgaagaaccgacggttcctttattaaacttgccagataatatatcaaaattaatatttgatttaaatattgggaatataatttataatatagatttaagtaattttaatataaatgaatatatagacatatataataatgtattatttgatatagtaataaaatataataatataaatttatataattatattataaaactttatccttattatgataaatattttattaagaaagatattaatactccatacatgtgtaagtatattgaattttataataattacacaactactattaatattataaacaataataatatatcaaatatattatctgataataaaatagaatattctacaattgtatatgaaataaataatactatcgttagtaatataataaataaaaaatataataataaaaaagattctaatattattaattatatttttaaaatattagaaggcgatcacacagataaagattattatattttattatttataaatataatactacttattgtatgtattataattatgtttttgttttattttattaatatttaattatattctgattttattataaatatattaaagagtattgttatatagtttatttttataatattatctctctaacatcatttcatttattaaaaatattttcattatatttaaatattaatctatgaaatatatatatcataatatgcgtgattaagaataaataaatatattttattgtaatagtggagtggagtaatatttatattaaaaaaaaaattataatgattgatatataatatcattttctataattatattttgttgattatcgtaataattgtacatcatttcattataatgcattctaatatcttcaagttcgatatttaattgttttattctttcgtcttgtttttgtatttgtttaaaatatttatatatatcttcgacaattatatttttatattttttatatttatttaatttagatgttgatattatccaacatataccaacatatgatatatatattttattttttattttttttttatatttaggtggtattcgagtatttactgaataaaatgaatttattttatatcctaaaatttttaatatatccgttaacaaatacattttttcaaattttaaatatgtataacatattttattttttattaataattcgtcaactacttccattttaacctttaatattattatatattttcaaaaaaataagaatatgatatatctatttattatttatgaaatattgatcattattactgtatttttcaattaatttaaaataaactttagaattaatcatataagttctatgacgccatttattaatttttaatcggaataataaactaggaaaaataacagtatttaaaaaatatatattttgcatatgtttttcatataatctatatttatttatatttatgcgcatattagtatgtctataaatatatttaataaaattcgatataaaataaaataatttataaatatcattttcaaaaaatataaaatcatcacatatatttaaaaattctatatttttattaatagttttttgtattatatcatacatacacattttaaatatatatggtgatacatcatttaaaatcaatttgggtttactattactaaatatattattcatatatatataatgatttaaaatatcattttttaatttattacataatatgtatttatttaccaaataacatatatgaggatatgttatgcgctcaaaagcatctttaaaatctaatgttaatatatatttataattttttattatttttatagattcttttaatacattattatgattgtttataacattaaatttattaaataatttaacatccacattatattcatcgatatttttcaatctagttaatatattttgttgttttggtgtcttaacattacaatataaataatatttatattcagcgttacttattaattcttttttttttatattatctattgaattattatataaatctataatattatcgcaaaaataatttttatcaaaattataaaatctatcatatctattttttattaatttagaaattatttttgtttcatggtcatgtgtatttgtaaaatttattactctagactgaaattcatatttaaaatttatatttttcaatggtatatctaaaacattatcatcaattttaaaatataaatttattttaaaaattataaagcgaaatattattttatgaaaattataattaattttaataaaattgtatacacaaataaaacattttttatcatgtattatactattattatatttaaaaacattattattatttgaaaaatttttcgtattatctattttataaataaaattattaatattttcattagaatgatttttttgtttaaatatattatataagttatttctatgttcgcaatcaacgtaattattattattgattatttctaataatacatctctactataagtcataatatttgtattaaaaacttgatctaatatacattttagacattgacgaacatatacccattctgcatatttaattatattaaaatgatattgaattattgtgttatacgaacattttgtacatatatgtaaagtattgcaagttaaacatctatcatttttacttaattctattatttctctacatattgtacaaatttttctattattaaaaatatcattaatatctattaacattttaatatttatttttatttttatattttatttcaaaaaaaatattatatactataattgaaaaaatataataattttaataatacttatctaaaatatttaacaatgaaaataattataattatatttatatgtatttatcaaacttttggtattaaaccaaacatatcattatgttgtggaattaacgaatattattataatgataaatgtattaataataaaacatattttttagaatacaatattgaaccattagtatatgataaaaatattaaattaacaaataaaacaatatatgacagttttaatataattattaacaaacttaatgataaaacatttaaagaaaaatcatacgatgttattataaataaaaaatatataaatatttatttaatagaaaatggaatattatatatggaaaattatcctaattcttataacaaatggataaaaattgatactgaatactgtataaattatataaaaataaataataaattaagattaagttatagaaatattataaatgaaaaaaatgatgataatatattttatttaataaaatataatatagtatcgtgtgtatttataatattaacattaatattatattcgttactttataataatagaataaaatataatgtatatgatttagaattatttagtttatttatgtttcaatatttaataactatattaaatatcgatactcattatgaattagtatgtaaaattttaacatatttaatatgtttctttgcgtatatgttattttcgtgtataaatattacatctattgtcatattatcaaatttatataatattaaaataaataaaaagtattgtaatttatatatagttttcttaccgataataataattagtatatttatattatttgataatattgatatgacaaattattcatggataataacaccaaaaacaaatacaagatcttgttttttaggttattatgaacgattattttacttatatataccaattggattaatgatattattaaattggataattttttcaattataatttttaaaatgtttaaaaataataattatatatggaaatggtctaatatattattatatttaaagttatctgttataatgggattaatgtggatatttgaaataatttcttcattttttgattataatattatattttatataatagatatatataattgtatgagtggttttagtttatttattgtattaatattaaatcaaaaatttattattaatttacataaaaaaaatatatatattaaagtataaaattatatacattcttcgatacaaattaattgtgttattatatatttaaatttagaacaatcaaaatttttaaaataatatagattattattaatattatttttttcgagtattttacataattttttataaatagtgtatatatcatgatgttgaaatgaaataactatataatattctttatctagattattaatattatacgatgaatataatttataataattatttaatttataatcggattttgtaactaaatatatataaccattactgtatatttcatttttaataataatatttatgtcaatatcatttagccattttctaaaatgattacttttttcattatttaattttgatataatattatttaaaccatttttatttattaatatagtttcgtcagaaatattcgaaggtatattattatgtatatttatccatttaaatatatctgatttttcacaatatttatatatattatctgttgattctgttaatatttttaatatatcattagatataaaataagataatttagtttttatatctacatatatataaatattatatttttctttggtatcagaaatatatatttgtttaataatggtcatgattaaaaatatgtcataattattcaataaaaaaatatataaaaatttttattatatttattaatattatttatttcatcaaaagaattaatttttgtgtttatacaagataatatttgtaaattattaagtttttcaataccctttagagatgtaatatttgtattagaacaatctaaattttttaaattaaatagattttgtattccatttaatgaatttatttttgtatacgaacaacataatttctgcaaatttttaagattatatatgtctaataaagaattaatatttgttttatgaaagattaaattctttaaattaacaagattttttatatcttccaaagaacttatgtttgtgcttgaaaaatttaatatttgtaaattagagtgattttttatttcttttaaagaattaatactcgtaaaactacattttaattctcttaatttagtaagattttcaataccttctaaagaacttatatttgtattattacatattaatacttgtaaattaatacattttgtaatatattttaaagaatatattttaatcttagaacaatttaatacttttaaatttataaaattttctatctctgataatgaatatattttagaatttgaacagtctatattttgtaatttattaaaaatttgtatacctgacaaagattcaatattagtatctgagcacgatattttttttaaattactaaatttttttatattttcaaaaggatttttatttatatttaacatattgtcgatatgaacacttttaattaattttggtataatacattttgaatttataaattttaatttagtttcattgtccaaataatctattataatttccaatatttctatcggaatattcattttgtatattcatggtgtatatataatacatacattagtttatatcatattttttcatctaaaataaaaaacctatataatatctaattcaatataattaaccgtttttttatcgatttctgttttattttttatatattttataataataaataatatatataacagcgataatataataattataattatatataatatatataatttaatattattattattattattattattattatatttgttatcgttgatatcttgaattatattattatatgaaatattttgtatatatacatgtttaattttaatattataataatcgtaataaaatatattatttatttttacatcatttttatatatcaaaattgatatattctctttttttatattaatataataataatcagtatttttatcttctaatttaacatcaacatttatttttttttttataatattatttttaaattcactccaaactaaatatttatataattcgtcattatttatgtcacaaatcatattattatagttacattcattaaaatatttattataatcaggtaaatataattctattcttttcatatatattatttcggaatgtgtatttgttccacaattccttaacgtaatagcataattatcgaacatgtatgaatcaatagttttattataatatagttgtttattattaaaaactaatgtactattagattttaatatttgatttctagttaagtttggactaatatatttaaattttgtttctataacattatcatttttatcacaaattacatcacacaatcttataaaatatccaaataatattccgtataatagtaaagaactattatttttaacttctaaatcaatattaatactatctatcgaatacatcttataaatcacaaagattaccttaatatattgatatgttatttcaaaatagatttttatgttattatcacaataacatatataatatcatagaaaaattattatagttcatctaattcaacataaatattatctttataataattattttttatctttttttttttaacattttttatatatattattataataagtgatatatataataataataatataataataattatacatatataatataatatatataatgtattattattgttattattattattggtattattgtgtggtataacattattattatcagatatattactaataattttataaatattatccacatttatttttttattttgtttatatatttttttaattttaataatatattgatcgtaagaaaatttattatttatttttatatattctttaggtatagtaattgatatattctctgtttttatattaatattataatatttcccattatttactaaatcaacatcagcattaatagtttttattaaatcttttttatctatttcactccatattatatatgtataaaacaatttatgtttttttatatcacaaatatatttatcatattcacatttcatatcatcaatattataatcgtcagaacttaaataattattcttttcataatatatttttattcttttcatatataataatcgtgaattggtcgttttttgacaagaagaagtaaaaactggatcattgtcatatatatatgtttttagttcattgttaaaagttaatttcttattattaaaaattaaagtattattaatatttaaaatttgatatttatcaatagcatctaatgtaaaatattcaaaatgtgtatctaataatttattatttatatcacaaattggtttacagattcttaaaaaatatcctatcattaacccatataatattattgtatcatttttaatatatatatcaatattaattttatcaattgaatccattgtataatataggaatagtcctttttaataaagtatgatatttcaaaattatatataaaaatagtataaaataattatttattcaaaaatcgtttacgttctacattatcacatattttaattatttttttaacaaaatatctcatttctgattctgtgtaattttctaaatcaggtaacaaacttaataataacattttatttggtttatttgtcattttaacacattcctcttttttaattacattttttatatcattaatgtcatctataatttctacatcagaataattaatatcattttgtgtatttattttatctgaatgttgttttatttttataaatggtctcaaaaatcgtaaataatttgttaaataatattctcttgtgatattatcactactttgtcttctatttaatgatctcatatacgaaactcttaattttctccatttataacgacattcatctacagtactattatattttttagcaatttcaatccacgcctttttattattatatttatttgcaaattgcgtattatatagacatggataatttttaacactttctataaagttaattagattacttttatttaaaaataaattattatcattcgccattgtataatatgttattattaagtttaatttttcaaattagattatacaattgatatacttttataagattttatctttgaaaaattaatctaatatttaatatttatttattattatatttttaaaattgaaaaaaaaaaataaaatatttataataaaatggagttaccattagaaatattagaaattatatttaattatttagataatgatactaaattacaatttatagattcaaaatgtattataccaaaacttatatatattagggcaaataaataattttattaatttaaaagaattaaaatataataattattatataaaatctttagaaggtattgaaaatttaactaatttaaaaatattatattgttctaatatagaaatcgattctttaaaagagatagaaaatcttattaatttaaaagaattatattgtcctgaaataaatattaattctttagtatatttaaaaaatcttattaatttagaaaaattagattgtaaatatacaaaaattaattctttaaaaggaatagaaaatattattaatttaaaagaattaaattgctcttttacaaaaattaattctttaaaagagatagaaaatcttactaatttagaaaaattatattgttctgatacaaaaattatttcttaaaagaaatagaaaatcttattaatttaaaagaattagattgtaaatatacaaaaattaattctttaaaaggaatagaaaatattattaatttaaaagaattagattgttctgatacaaaaattaattctttaaaagatatagaaaatcttattaatttagaaaaattagattgttctaatataaaactaaattcttaaatataaaacaaaatatgttaatttataaattagattgttatagtataaacattttattttttatattaaatttgtaattgaaatattataacataaataaaatattctattatgtataatatatctactattcttagtaataataaaaataaaataaataaataatatatattatactgattttaaagaattgtgtatagaaataaaaattaaataaattttgatgaaaattatattttacaattaatgatagaatattattcttgagatgagtctcgtggatgtttattttaatacaaaatacaaaatttaattctttctgaggattacaaaatcttttaaagacaaatgcatatatataaaacaaattatattgttatgtcataaaaatttgtttttgaaataatataaaacaaataaaacactatgtcttcttacgtagatgaatatatagatgaaattataaaaataaaagaaaattctgataatataacattagatattgtcataaaatgtattaaacttatcgacgaagaagatttatatattttaagaaataaacgtaaaatttaaaatggttatgatgttgattatttcactaaaagcggaaattatataatagaaaaaggtgactggtgtcctcctaatcgttatataaaaaatataaatttctataaaaaaatgtatggagatgaaaaaggaacacaaatgtatgaaaatatacataaatatgataacgaatatattttattttattatactaaagatgaatttaaacatataaaatctgataaaatagatgataatttcaatgatgtgtttaaaaatatattaacaaatataataaattatataaaaaatacggatttttattaatctatgttataaaaaaataataatttttttgaaaaaacatatttatattaatatataatcatggacaagtatataataataaatggatttataactatttttagtcaaattatatgtaatgaatatgattattgtttaaataaaataaaaatacaaaatcatatagtaaataataataatattactatagatggatatgatatacacatagataaaataatatatataactaataaatataaaaaattatacggaaacaataatataaatacgaaatatgaaataaatattatacgcagaataaatatattttatgattctaaaaataaaaatgtatctatgtcttgttataataaaaaatgtaaatatgatgattatatatgtaaaattaatgataacgaatatatattttgggatgttttaaactttgatacagtaataaattcatctaatataatttatgaatgtgatgataatatcagagattttaataaagtaggactaatgtcaaaatatttaatacctagtatcataatattaataatattaatattaataatattattattaagatttatttacattaaaaaaatatttcatatatatgaaagcgtaagataataaattatttttattaaacagtatcaggccataatgattcataagtaggtaaactactacgtctatgtctatgttttttacaaacatctattaagaaagatattgttgcattttcaattttatcaattttaacagcataaattgaatatatacctatcataattaaaatataacatattaataatattatatattgtattttaaaattttctatacacaaagttattataatatataatgttaaaaatattgataataatacaaataaatatcctataaataaaattaataaatcaggtagttgtattttttttttatttatttcatttttatatttattataacaatcgatacatattttattatcataattattaatattattaactgacatattgtatatattatataataccaagaaatagatcttaatgtatattattttttttcaaaacatctttcctattatttatataaatatataaataatatattataaacattataaatataacaaaatacaaaaataaattatatatattatttaatgttagtatagcataatcaactatttttaaagaatctaaattccaaatatatataacgttaataggaaataataattcaccatttttatcataaattaataatctcccaagtggttcagcatgaaataatttaaatgtagtattattatatattcttatatatctttcgttattttctattggaacagtaccatatatactatattcgtatattgttctaaaaaaacgtgttatttttatataaaaatataaatcaaacacccaatgaggtctattattttctatagttgtaatttttgcataagtttttttattaatagataaaatttgtatattaagtagtgttaaattattaaaacctataacttgtattttattcatttattttataaatatagacattattatatccatggtctccaatattcttcttgtttattagttaatattatctcaaatgtaggataattatctactaataataatttagtattatgaactctagtataatgtatttttagacctcttacattcatcatcataagattacataatttacaaaatgcataattattatgagaataatttttttttaattctattctcaacatcttgtataattatattaattgtaatgatatattttcaaaaattgaatttttaataataaattaataaaataaacaatcatgaatatcaaaaaaatttgtaaaatactttttggaatattatttgtttttacaactataataatatatcataatataactaataataatgatgaatatgatattgaaagaaatataaccgaaatatataaaatattaaaaaaatatgaaaaaaatattgataatattaatgaatatttaaagaaaaatgatttatctgaaataatagaatttactgaatctactataaaatcaacagatattacggattttattaaatcaactgattctactataaaatcaacagatttaagtgaaatagtatcaaatactacggattctattaaatcaactgattctactataaaatcaacagatttaagtgaaatactatcaaatactacggattctattaaatcaactgattctactataaaatcaacagatttaagtgaaatactatcaaatactacagattctatggattctattaaatcaactgattctactataaaatcaacagatttaagtgaaatagtatcaaatactacggattctattaaatcaactgattctactataaaatcaacagatttaagtgaaatactatcaaatactacagattctatggattctattaaatcaactgattctactataaaatcaacagatttaagtgaaatagtatcaaatactacggattctattaaatcaactgattctactataaaatcaacagatttaagtgaaatagtatcaaatactacggattctattaaatcaactgattctactataaaatcaacagatttaagtgaaatactatcaaatactacggattctattaaatcaactgattctactataaaatcaacagatttaagtgaaatactatcaaatactacagattctatggattctattaaatcaactgattctactataaaatcaacagatttaagtgaaatagtatcaaatactacggattctattaaatcaactgattctactataaaatcaacagatttaagtgaaatagtatcaaatactacggattctattaaatcaactgattctactataaaatcaacagatttaagtgaaatactatcaaatactacggattctattaaatcaactgattctactataaaatcaacagatttaagtgaaatagtatcaaatactacagattctatagattctattaaatcaactgattctactataaaatcaacagatttaagtgaaatagtatcaaatactacggattctattaaatcaactgattctactataaaatcaacagatttaagagaaatactatcaaatactacatattctatggattctattaaatcaactgattctactataaaatcaacagatataagtgaaatagtatcaaatactacggattctattaaatcaactgattctactattaaatcaacagatttaagtgaaatagtatcaaatactacggattctattaaatcaactgattctactataatatcaacagatttaactgaaatactattcaaatacttaccagattctattaaatcaacttgattctactattaaaatccaccagattttagtgaaatagtatcaaatactacggattctatagatttaataaatccaactgattctactataaaatcaacagatttaagtgaaatagtatcaaatactacggattctattaaatcaactgattctactataaaatcaacagatattacagattctatagattctattaaatcaactgattctactataaaatcaacagatactacggattctatagatttaataaatccaactgattctactataaaatcaacagatttaagtgaaatagtatcaaatactacggattctatagatttaataaatccaactgattctactataaaatcaacagatattacagattctatagatttaataaatccaactgattctactataaaatcaacagatactacagattctatagattctattaaatcaactgattctactataaaatcaacagatttaagtgaaatagtatcaaatactacagattctatggattctattaaatcaactgattctactacaaaatcaacagatttaagtgaaatagtatcaaatactacagattctattaaatcaactgattctactataaaatcaacagatactacagattctatagatttaataaatccaactgattctactataaaatcaacagatactacagattctataaatctagatgaatctactataaaatcaacaaatattacaaattctaaagattatttaaaacaaatgtataaaacatttttattgaaataatatgttaaaattaatatacacaatatggctttattaataaaagaagataacaaaaaaactattgtaacatttgatattttaacaggaaaatgtataacaaaattaatatctaataacgaatattacgatattattgatcgatataaaaatttttataataaaaataagaataaataacttttatatatactctctaatacatattttataattataattattaaattcgtcattaaaatatctaaataacgtataattatttttattatatgaatttatataattagttgttaaatatctattacattcatcacataaaatattaattaaacaaaatttacatactccgactttatcttgaatactatctatatttcttaattctacataatcaatattattataattaaataataatttatgacactcaatacatatttctgtattttttttacatatatcacataataatatattaaattttttattttcatatctataaccatattttgtagaaaattttttaatcgataaattattatataatttattacatccagaacataataatttacaataattacaaattatttgattattattaaaaaacatacatttgcaattaaaacacacatttttatttattttttttcttaaacctataggtaaaatatttaaatcagttatacttctaattgctatatcttgtaattttataaaatccataatgatttatttttataaatatgttttttttcatattattatatattattttgaaaaataaaataaatttataatataataatcatggacgtagaacgtaatttaataaataatagattatcaacatttcaaaatgattataaaaaatatatatacatatcaataattttaattttattaataataattattatattaatttgttatataatttttgcaaaaaaagaaagtaactataataatgatagtaaaactataaataatattaaaaatatatattctaataatatgaatgttatgtatgatgatgaatttaaaaatgccattataagatactataataaatatataaataaaaattcagaagaacaaaaaatatttgaaatagcaagaagtagaataacttctttatataatatgaatataacagatattatagattatgatagatgtggagtaaaagataatatgaaaatgatgataattgatgaaatgtgtaatgattacgataatatagttaatgtttattatagattaaataattgtgataatatcagatcaagagaaatacaaaatagttttaaaatgtatgaaaattataatattatgttttataatagtgaaaaaaattataacatagacatatattgtaattataataataataatttcggctttatgtataaaaaaaataataaaataataattaacttaaaaacaaaaattttaagtagattaaagtatgaaatgtatcatatgttaagtcatatatttatttataaacatgattttatattaaattcttatacatttccatatatagaatattataatgataaaaatgaaatagacgaagaaagaatatatatgtttaaaaataatataagaaattgtacttaaaattgaaatattaaataaaaatataatataacagttatgttttggttaatattattaataccttcatttattatttgttgtgagccgaaacaaagtaagtatttctgtgatatatattacgattgtataaataataatttaattatgaaatcgtgtaataataacgaggttagatataataatacttgcataacacaatctgagtataaaaatattactggtaattattgtcatagatgtaataaaaatattttaattccaggaatacattataatcctttaatgtgtaataaattatctaattctatgtgttgttttgaagaagataattatattatatattgtactgaacaaaataataaatatatttggattaaagattattataatacagattgtaaaagtattttagaaaaaataaagtattaatttttgttttgttgaatataatattttaaaaaagtattttcgtttaataattttttaattaattctaataaactatcctttgataaataattatatgacatttctattaaacatttacaatcttccatagattttaataaattataattattagattctttatttattttatcatttgctattccgttaattaaatctttatcataaactaaagaataattatctaatttaatatatatttcatttaacatatcttcgttagcattcatttattataaatatattgaaaaataaatatataaaataaaaatgtttaacatggatatttgtgaagaatgtggatatgaagatataaattgtgtttgtatttatgaatgtgaatattgtggattttctatctttgaagcatggtgttgtgattgttgtatagaatatgattcttattaattattctgaatcatataaatcagaatattcatcatcattttttctattaatttctgtttttaattcagttaaaatattaagaattttttctaaaatctcattagtattttgtattttattaacaatagaattatcaatatcttgtacagaaggcattatttattattaaaaaataatattaatgtatatactataaataaataataaacttattaataaataatatttgtattaaaataatataattcttctaatttaataagattttttattccttctaaagaaataatatttgtattattacaatataatatttctaaattaataagattttctataccttttaaagaattaatttttgtattatgacaaaataatttttttaaattaataagattttctattccttttagagaatcaagttctgtaacataacaatgtatttgttctaaattaataagattttttgtttgttttaaagaatcaatttttgtataagaacaatctaatttttttaaattaataagattttctattccttttaaagaattaatttttgtataagaacaatctaattcttttaaattaataagattttctattccttttaaagaaactatttttgtttcagaacaatctaattcttctaaattaattaaattttttaatatttcgataaaatcgatatttataccataacaaattaaattttttaaattggttagattttctaaatattttaaagaatcaatatttgtatttgaacaatttaatttttctatattaataagattttctattccttttaaagaataaatatttgtattatgaaaatctaatttttttaaattaataagattttgtaattcttttaaagaattaatttttgtataagaacaatctaatttttttaaattaattagattttgtaactctttaagagaataaatatttgtttcataacattctaatttttttaaattaataagattttttatttcttttaaagaattaatacttgtataagaacaatctagtttttctaaattaatgagattttctattccttcgagagaataaataattgtatgtgagcaatttaatttttgtaaattaataagattttttatctcttttaaagaatctattagtgtataagaacaatcaaattcttttaaattaatgagattttctattccttttaaagaataaatatttgtttcaaaacaatataattctgttaaattaataagattttttaaatatactaaagaattaatatttgtattaaaacaatataattcttttaatttaatgagattttctattccttttaaagaatcgattcttgtattgtaacaatataattttattaatttagtaaaattttcaataccttctaaagattttatataataattattatatattaattcttttaaattaataaaattctttatttcttttaaacaagaattatattttaatttatatataagttttgatataatacattttgaatctataaattgtaatttagtatcattatctaaataattaaatataatttctaacatttctacaggtaactccattttaacataattattttttttttcaatttttaatattagaatattaatataaatgtttaacaataatttatataaaataattaatttatgtatttataaccatttaatatttttaataagcagattttttattattatatttaaagaataaatttttatattataacaatataattcttctaaattattaagacttattccttttagagaatcaatgattgtatatgaacaatttatttttttaatattattaaggcaacatatttcttttaaagaattaatttttgtaaattagtaagataatgtattccttttagagaatcaatatatgttttagaacaatctaattttactaattttcaataaattctaaatattttaaatatataaattataattttatgtatgtatctgtataattaaatataatttctaaaatttctataggtaaatccatagttagtagttatgatatttttttttttcattttaaaaaaat

SEQ ID NO: 28 - DNA, 501 bp, Amsacta moorei entomopoxvirus
  exon (1)..(501)
atgaataaaatacaagttataggttttaataatttaacactacttaatatacaaattttatctattaataaaaaaacttatgcaaaaattacaactatagaaaataatagacctcattgggtgtttgatttatatttttatataaaaataacacgtttttttagaacaatatacgaatatagtatatatggtactgttccaatagaaaataacgaaagatatataagaatatataataatactacatttaaattatttcatgctgaaccacttgggagattattaatttatgataaaaatggtgaattattatttcctattaacgttatatatatttggaatttagattctttaaaaatagttgattatgctatactaacattaaataatatatataatttatttttgtattttgttatatttataatgtttataatatattatttatatatttatataaataataggaaagatgttttgaaaaaaaataatatacattaa

SEQ ID NO: 29 - DNA, 432 bp, Amsacta moorei entomopoxvirus
  exon (1)..(432)
atggaaccaatatttaaatatatgtttgttacagaaaatgcttttgaacctattagacagacatcaaaatctgcaggaatggatttaaaaagtgcatatgattatattgtttcagcacatgataaaaaattaataaaaactgatttaattatagaaattcctaaaggatgttatgcaagattagctcccagatctgatttagctctaaataaatttattgatattggagctggagtaattgacgaagattatagaggaaatgtgggagtaatattatttaatcattctaatgaagattttataataaatagaggagatagaatatctcaattaatatgtgaaaaaattttatatcctaaaatgttaaaagtcgatagtttatcagaaacaaaaagatctgattttggttttggatctactggttataattaa

SEQ ID NO: 30 - DNA, 780 bp, Amsacta moorei entomopoxvirus
  exon (1)..(780)
atgtttaaaacagatttaactaatgaagaagtatcagaagctgctaataaattaataaaaaataatacttgtaatttctatgaattaaaattagaaaatattttagacaatattgatttaacaaataattgtatatattgtaatgatgtaattaaagataaaattattatagatacaaacaatataaaagtgggatatttttgtacaataacatgcaaacacatatattattcaataataagaacaattttcaatttacccattcataaaattattaattttataccattttttttattatccgaagaatctaaaattaaatataaaaatataaaaaatattattaattattataattatgatgatatatctatttttagtaaatataaagataataataatatatatactgaatttaaattattaattaataataaatttatttatctccaagaatcgtttgaatatatatcaaaaagtaataattgtatatattgttattctactaatataaatgataaaataatattagagcataataatggaattattaaaggtttttgttctatagtttgtagagattcgatatctaaacaaatatataatacaattatgcctatttataaatttagtgcatatttggtaccatttgaattaataaaaaataaaaaagaatttttaaataatattaatcatataaaaaatattgataatttatatggtggttattgtcatttaactaataataaaactaaagtagaattatttattacaaattaa

SEQ ID NO: 31 - DNA, 1050 bp, Amsacta moorei entomopoxvirus
  exon (1)..(1050)
atggttttcgaacataagatattttcatataattttactgatattaaaaaaaaaaaaatatatccaatatgcaattgtattattaatatttttgataaagaaattaaaataccaactttaactaaagcaataatagacaccaaacataatttaggacctatatatctaaatatagctaatatgctggcgtatgttgatataatatatttatttaataataatttagatgaaataaataattgtggtatatacttaccgattattgacgatggtagcaaacattttttaacttataaagatataaaattatttatatttgatgacgaaactggtaaaataaaaattattgataatcctaaacattctgataaacatcatataataaatttatctaaagaacgtaaaacagatgatgctataggttcatcacacgttttattattttcatgtaattcaaaaattgaagaaaatatcaatttgcataaaaatattttattaacatttaaagattatcctgtgaaagttgatataaaaaatgaaatagaaaattctaaacattattatgaaaaaaatttattatataaaaaaccattttctatgtatagcaaatatcatgaagaaaaagatatttatactatagatataagatataatcattatgatgatattcctaaagaaaatataaaaaaattctttattgatatatttaataaaatagcagatatatttgaaaatattaaaattaaaaaaaataatgttgattatagtaataaaataagttattctaatatattagatcataaaatgaattataaatatattaacgtagatgatattatagaaaagaataaaatggatgcattgtgttctataaatgatatacctggaataaatggaacatatttaaaaccatcagatgaagagattaatgacgcagaatattcattaaatactattatgagaaatacaataaaagaattattagaatcttttataaattttattgatgaaacatacgaagaacgtttaaatagtaaaaatatatattaa

SEQ ID NO: 32 - DNA, 2469 bp, Amsacta moorei entomopoxvirus
  exon (1)..(2469)
atggatcagatagaaataattaaaactattaatagtatgatagaatatataaaaaataccaaagataagttatctatagataattttatattcgaacataaagatttatatgataatgtagttatttattcaaaatatttatcagataaagattttaaatttttatacgttattgtagaaaaatatccagacgcaaatccaaatataatatataatatatttaaaacatcacagatatctataacgcaagatattaatataaataaaataatacagaataaagataatacaaaaataaaccaagatatacacacatataattatttgttattattaaataaattatatatatttcaaccaataccaaaatttataaatatattatgggatataaaatcaaaaaatgtagataatctagacaaaataaataatataaatacaaattcgttaaatataattacaaatatagaaatgtcaaaagttaatattatttatatatcatttacatatatttcatcttatatagaatcacataaaagtgaacttacgttaaataaaaaattttctatttatgataatttaagaagaataattggcgttcctatatctaataataactataaattaaattattatattaaagctaaaatagattcagaaacattaatatataatatatttaattctgtagcttttaaaaaagtaataatatatggatttggagtttatcaaataaaagatgtaaaaaatataataaaagatacgattaatgatgtttcgtcatacatagttaataataataaagaaaaattgtatcaacgtacatactgttgttgttattttttaaactgttattatgaaaaaatttttaaaaatttatccacacaaacatatgataaaatattatattcaaatgtagttaatattaatgatgttattcataaaaaatatgaatatttcgaatgtcaacatgtacaagaatataaaaatgtttttaaaaatgtagaaaatttttatattaatactaataaatttctagaaaattatattaatattgttaataaagtagctatatgtaaaatttgtggagaatcgttagatatgtttaattttgaagaagcaaattatattcaatctaaaggcgaaattataataacaacaaataaagaaaatattttccaatatgaaacttattcaagattagttaatgctgaattatttttaacagatattataggaatttatgatgatatttttaacacaaacagaatggacgattttaataatatatctagaataattattgatttttttattgatattaacacaaatagattagaatatcaagataaatataaaaaacaaatctctaactccaaattattttttataagattgtcaaataatttatttatagcagtttataatgaaaaagaacaatatgccgaagaaagacaactaaacatgtttataatattcggaatatctttattattattaagtaattttaatgaattaataggtataataaaaaataataaaaaattaaaaactatatttgataatcaaaatgatattaaaataaatttagataattttataaaagatactgtattcatatatataagtaggaatagattaatagataaaaaaagtagagaattgattaattatgatactataattgatgtttatttaaatatattaactcccgaattaaaatcgtgttataatataatattaaatagattatataaaaatatagatattttaaaatatgattatatagaattaccagatattccattactacccgtaacattaggatataaacacaaaaatattgatactggtcctacaatatcttttttaccactcgaagatgtaattaattataataatgtaaatatttatgaaagtaatattagatatattacatacgatacgttaaaaattaaaaatttatctgattttgatattaaagatataaatgttgaattaaaaactataattgaaagatttaattctgaatattactatagaaatattagtatattaaactttgaacagatggataattataatttttatatagatataggacaaaaatattttttttatataaatgatgtattatcgaatagtaatattgtaataaaaagtaatatttattctaaaataatgaattttggtgattctttgccatttttaaataaaatatataaatttcattatacattattatttgataatctgaatttattaataaattttttatatccgaatgttaaaattatatttaattatgatcaagattatataactagagattattttcattatattgtttataatatattaatttcattaattaatactaatatattatcatggatagatgtaaacaaagatataatatctaaattatatgataatactttaagattttatgttaaaaatatatattaa

SEQ ID NO: 33 - DNA, 1410 bp, Amsacta moorei entomopoxvirus
  exon (1)..(1410)
atggttaaatatattaaattaaataaaaaaatatttaattatataaaatcaagattaaaatcacaagaaatattaatatatgataaaaattctaatcatgctataattacaaatgatatgatagaaaatattgatttagatataatatgtccgttgattttgtataacgaaaatgataaaattattgacaaaattaataatatggataaatttattgagtgtaaatatcaattaagggaagatcaattagagttaattaataatataatgaatattaataataattattcttgtaattcacccatatatttatcattagtatgtccttgtggatatggtaaaactatattgggtatagatataatatctagattaaaatacaaatgtgctataattgtacctagaatttttattatatatcaatggttagataaaataaaacaaaaaaataatatatttgcatctacgtgtggtagaaaaaaagcgattgaacaaataaaaaatggtttagagtgtgatgtgtttatatgtcctgataaacatttagaaaatgatattattagaaattatatatataatacgtgtagtttagtaattgttgatgaagctcatcgatataatgctaataaaaatatagtaatgactagatttttatataataaaatatttaaattttgtttgtttttaactgctacgccatctaataatatgaatacttttataaatgaatttattgatattaataatcaatcacagattaaaatattaaatgatattaaaaaaaaattaattatatttaatttgaaagataaaatatttactccaattaataataattgtaaatattatgttaataaaataacaaataataaattcaataatatatatataaaaaattttaattacaaatattgtatttctcttgatgataaaagaaatgaaattattatagatttaatattaaaaacaactacggataatacaaaatgtttaattttgacagattatagattacacatgatgaatatatataatttattaaaaaaaacacacttacaaaatataatttatatatatgatgtaaaaaataaaaaatgtaatgatttgttaacagaaattaaaaataagaatgaaaaatttattattatatcaactatatctgcttgttctgaatcattagatattaataatttaaatacttttcatgttttattacctattactaattctaaaacaataaaacaatgcataggtagaattatgagaaatatgaacgaagataaatatacttatatatataatttttctaacatcaataacatgattaatatgtatattaatgataaaactgatttaataagaaaagtattgtctgattgggaatgtgtagaaataaaatgttcatattaa

SEQ ID NO: 34 - DNA, 768 bp, Amsacta moorei entomopoxvirus
  exon (1)..(768)
atgtattgtaacccaatagcatttatatctgattttgataattcatacgctggtagagttagatacatagataattttatagctggagctacaaatattccagataataaaactatttttaaaataattggaggaaaaggtgtttttttaaaaactaatagtcaatataacactataccatatacatcacctactaaaaaaaaaaataattacttagtctataatatatatgatttgcgagattatattagtgaaaattcaaaattctcgataaatgattttatgaataatattaataattcgtcacaaaataatagaattatggttctgagtggtgatacaaaatataaaataagaaatcctaatagattaatattttctgatacatcttatcctattttagttacttataatttaaatgataaaattaatatatctatcgaaaacccaaatgaaaaagtagaaaaatatgaaatacccgaagatgtttgctatgtctataaacaaaaagatacatatgtaatgtcggttaatgttaaacgtttgacgccagtagatatatattatattactaccgaagttgatcaaaataattcaaataatataaaatctataaaaatagaagatacatcagaacctttagaaatacacccatcttatagaaaaatattagtaacaaaattagtggattttattaatcaaaatataaaaccaactaattttaatttttcagaatattttgataagtatataaatactactaaataa

SEQ ID NO: 35 - DNA, 3591 bp, Amsacta moorei entomopoxvirus
  exon (1)..(3591)
atgaataataatccgattgaagaagatattgcaaatttatttttgcaatgcgatcctagattggatataaaatctaaagttttgattaatgtagaattaccatttaaaaatttaaattatgatttgcctacgttatttaatagagaagaagttatatatacaaagataagtaaatcaggacatgaagatgtcataatgaaaataacatacgaaggtaaagaagataataaaaaaagttatttatattccagtttagataataaaggattttatacatatatctctatttctatttctatatatagaaaaataacatcattaaataataaaatagaatataaaataatatctaataaaacatattcgcatacagaaataagaatacctcagtatatagctcacggtggaaatacatcagaaaatgataattctataacacaatcaaataatcctggtggattttttaatgtttcaaaaagtttaaaaaaaatggtaactactagaatagaacaaacatatatttatccaaaacgtaaaaaaactcaaaaagcatatacttatcatctggcattcattagtaaaaaaccatcatttatgatgataaatgaaaaattaaacccgccacagtttttaactttagatatagattttaatccagataaaataaaatgtgtaatagattctaaaaaaacattcttacaaattgatatcatagcattaataatagcattatctaatgataacattgatgttgtttataaaaaaataagttctggttttagtgatgatatatctgattcaatcaaaatattaatagaaaatactaaaaatattttatctgaatataataatgatgccagacaatatgtcgacaaaataatcgaaattaattatattaaaaaatatccaaaaaatgaaataactttacaagattattttaataatattttcaatgattttcttcctcatataggccgaggaaaatataatgaaaaatgtatgtatatgattagtattttaagacaatcttttgtttctatatttcaatcagatgtttatccagataaagataatttagctactagaagaatttcaactgctgctgatatttttgagaatataataaggacttctattgataattctttcgaattagcaagagataaatataaaacatatattagtggatctggtaagaacaataatataaataatattttatctcaagttaaattattaccacaaataacacaagcgtttaataattttttcaatatgcaagatactaaaaatagtgatgttgtaaaaataggaacccactcaaattgggctgaatctatttatatttctaatgctgtagaaagaggtgttagtatagaattaacaaaatcactaactcaaagaaaattacacgcatcatcaattaatgtattagatatgatggatacacctgatcatggtacaaaaactggtcttgtaaaaagattatgtataagtacattaatatcacactatcctatacatattagaaaacaattatttgaagaagttagagaatttatagaaaacaaggttaaacatacattaaaagaagatattatttccggtgtatttatatcaattatagatgaatctgaacacgtaatagctcgtataaaaaattcagaaactgaatcttttataaaagatttaaaatatgcaaaaatatcaggattatttgttaaaaatgatataggtatagaaatattaaaatttcatgaattagataataacaaacaaatatatgtaccaacagatagatattttcaaataagaataaatgttggtaataaaagagcaacacaaccagtatttagagtagaaaatggcgaattagcatttaataaatatcctaatttacatgctgaattaaaagagagtaattcttacactgattttgtaactaaatattatgatattatagaagttattgacgtaggacaaatgatatattcaaatatgtgtaacacagttacagaatttaatagttacagtttagaacaaagaaaaaaatatgattatgttagattaccaaattatttatattttagttatttaacatcgactggttgtatgtatgatattggtaaaatgacgggtgttagaggtacatttggaacagcccaaagtaaacatattataacaggacctccagataatgtaatgaataaatatgatacatgtaactatttagcatatcctatagaaagaccatcaataactaatattcctatggaaatatctggtatagcaagaaatagtataggtacacatgttttagtgggattctttagttttaattacaacgtagaagatggcgttattgtaaataaagaatcgataaatagaggattattatctgtaatatcattaatgtctgtaaaaaatgaattatctgatacacaaataaacaataataatccaagtgcagaaaattctaataataattattctaaaatatcagcaacaggtttgccatcaataggaactgttttagtacaaggtgatgcgttatacagatgtttaaaaccaaaatttaaaaatgatgatgataatagatatatatttgatcaatctgaaacactatctaatacttatccagccgtggtagaaagaacaagaaaacaaggtacagatttaataaagattgatatgctattgtcatcatatagaagattgagtgtaggagataaaatagcaaaatctgtacaaaaagttactgtttcaaaaattatggaagaagaagatatgccttataatgaaaatggcgaaagacctgatataatatttaatagtcctagtattataagtagaaaaactcttcctttgtatgacgaagtttctttatgtaatatgttctcaaaaataccatataatgataaatgtgatgtagaatatattaattatcctatatatactgataaaagtcctttggataaatataattttatcaaaaaagaattaaaaaaaatatataataatgtaactgacgaagaattagaaaatattatatattgtcgacaaacattatatcacccatatacaaaaaaacctatgactataaaagaaggtgataaagaaactaaatcatttatgggacctatgttattctgtagattatcacaaatgtcggcagataaaatatcagtaagaaatagaggcagattagataaatacatgcaggctccgtctgggaaaaaaaaaggcggaggtattaaaatcggagaaatggaaagtgatgtttttgctacaaatggatctgtatatgcaatacatgaattacaatcagatcctgatgaattttatttaccagctcatatatgtggaaattgtggaatatttgctacttatgaagaaaatatagaagtaaaaagatggaaatgtctacagtgtgaaaatcttggtttgtcaccagaaataataaaaatgcgtttaacttatgctacaaaaatatttatcacacttttaaatgctagaggtatatctctaatccctgtaaaagataatcagtctatacgttatatttctgacgataatactattaatacttaa

SEQ ID NO: 36 - DNA, 498 bp, Amsacta moorei entomopoxvirus
  exon (1)..(498)
atgaatatatcaaatataaataatgatatatatcttggtggtttgggaaatcatagcacagaagaaataaaaaattttctaattgataataatattaaatgtataataacaatatggaattttaataaattaaatataaaaaaattaaatattaatgttaaagattatatgtatatacacgcatatgatctaacaaatgaaataattattgattattttgatattactaacaaatttataattaataaaataaaagaaggtaagaaagtattaattcattgttatgctggtatatcaagatctgcaagtatagttattaattattttatgaataaatataatataaattatgacgaagctgaaaaaatagttagtaaaaaacgaaatataaaaccaaatatattttttatacttcaattaaaattttataattcatataaaaatataaatattatttatttaattatattatttgctattagatatacactaaaatga

SEQ ID NO: 37 - DNA, 210 bp, Amsacta moorei entomopoxvirus
  exon (1)..(210)
atgagtgaaaatttatattatgtaccagacatatgtaaaaattgcaataagttaaatcctaataatatattggtgatagacggtacatatagagctgcctataatgattattattctgttagtaataaattgccatctattaaaacagaaaaaggtggattagcaaaatatccaaaaaaattatttattagaaatggttattataagtaa

SEQ ID NO: 38 - DNA, 2163 bp, Amsacta moorei entomopoxvirus
  exon (1)..(2163)
atgcaagaaattaaaaatatttatgattttaaaacatataatttatttcccgaattacataataaatataactatatttcacatttattatttcctaataatactaatatatttcaatcatatattgattttgattatgtaaaaaaatataaatataattttttaatattattataccctgtttacaaactatattggaaaaatatgtatatttgttataatcaaaatagtaataaaatatatttagataataaagaaatatataataccagtattgaattaattaatgattttttaatagatggaatagatataaataataatattataactattagatcaaacggatctacaattacttattctgcatacgcatatgcaacaatattatatgatttaccatatagattaggaaatttagatattaatcaaatatttggaattgtagaaagttctaatatattaggaatattatctacaaatgaagaacaaaaaaaaaagtttcctaaatatattaataatatagaattagaaaaaaatatattatttaaatttaaggaatctaaccttagatcaatacaaattgatgtacaattaaaaatatttgatttatttataaatagattaaattgtgttgtttctggtggaactggtataggaaaaacatctattatacctaaaataatatggtggtataatcttctttttgatggatataatatgtttaatagtagaatttctaatgtatctatagataattttatatttgatataaatataattgaaaaaaatacattattatcattacctagaaaaactataataaatagtactgctattaattatataaaatcactaggttattctgaaataacagaaactcccataataataaaatataaagatataaaattatataaagaatattataataataaaattatttttccaactaatttattattgtgtgttaacagattgtcaataaataatttaaaaaattccagtgttataattatagatgaaatacacgaacatgatagatatgctgacatatgtatagcagtatcatattttttaaaaaaagttataaatatcagaaatataatattaatatctgcaacaatagaatttgaaatagataatatattaagattttttaataataaaatagtacaagtatatatacctggatttacattatttcctgttacagaaatagaaaatacggttgatagtatagataaaatattattagataataaaccacctgttggatattctgttataatattttatgaatcaataccaaaattaacttttattaaaaaaaaattagaagaaagtataaaagatcctatatataaattttattctatacacggaaaaacagataatgctaatgaagttattcgttatatagaaaataataaaaaacatattcatgtcataataagtacaaattatttagaatcatctataactatatcgaatgctaaattagtaatagataatggaaaagtatatagaaaagaatttatagatggaaatataacatatataacaaatagtatgtataaacaaagaaaaggtagagtaggaagagtgtcaaaaggaacatatataagaacatacacattagataaattaaatactaattttaaaaatataaattatcaatatttatgggattacataataatttttaaatattatggtttagatataaaaaaagattattttgtaattcctgataatattaatagagtagataaaactgttaattatatgaagtctataggaatagatatagataaatgtataaataaaatatatagaatttttaataaatatgaaattaatatgttagaatattttattatatatttgtatggttcagaaactgagaaattattattgagcacagatgataaaaatataattgatataccttataaaatatataatatatatgtaaaaatgaatgtaaaaataaaattggaatctaaaagaagtattatatatatatttaaatttattaatgatgtatatgatggtccgcaaaaatttaaatatattaatacagacgaaaatgtatattttgataaaaataaaatatattatttaaaatctgaaaatccactgattattatgagagattaa

SEQ ID NO: 39 - DNA, 813 bp, Amsacta moorei entomopoxvirus
  exon (1)..(813)
atgtatatacaaataccagaatataaaaagtcatatatgtgtaaaagtttaataaactctggaacatacggaattgtatataaatatgcagatatttatacaaaaaataatgttgcgattaaattttttagaaataatgataattttacacacgaaataaatattttaaattatattaaaaaaaaaatatataataattctgatagtgatgaaataaacgaagttaaaaaaaatatctgttttccgatattttttacaaatgaaaataatgtttcaaaatatattatatttaattattatgattatgatttattatattacgcatctacatatatattacttaatcaagatatattaaatataagtttacaaatatgcaatggactgaaatatttacataaaaattctattgttcattgtgatttaaaaccagagaatatattatgtaaatataaaaatgatacattgcatcttgttataacagattttggattatcgtatatagaaaataatattattgattatgaaatcgtaacatttagttatagatctcctgaattaatatgtactattaataataaaaacaatataattgtaaagtcttctatagatatgtggtcttttggggtaattatatattttttaattaataaattttattttgatatttataatattgaaaaatatatagaatctaatcctataaaaaaattatgtaacattaactcgattgttgatagactgctacaatatgaaaaagatagatatacaagttatcaaatatataatgatctgaaaaaattattgaaataa

SEQ ID NO: 40 - DNA, 2181 bp, Amsacta moorei entomopoxvirus
  exon (1)..(2181)
atgtcagacgaatatatatatttacagaaatctttaaatgttactaaagaatctaaaatagatttaatattaaatgataaaactagtaaagatttagttaaaataagtatatccaaaatatgtagaagtattttaaaatataaagatagcaatcaacctatttctgaatatcatgaatttatacttgatgatattactgattattttaaattattttttgatatagattgtaaaacagaatatgaaatcgatgatgttaaaaaatatattaaagaatttaaaaaatttatatcatatgaattgtataatatattttctaataattttgatatagagaatcataacatcgataatataaaaaaatttatatttaataatatttactatacattatctgataatccgcacaaattatctttacatatattttttaatcaaatattagtaagtcctacatcatttatacaattaaagaaatatataataaatttaagatcaaaaataaataatattttaatcaataatatagatttagctccttttagaagaaatacacaattaagatttatatatagtaagaaaaatgatagtgaatattttcactcagagcatgattataatatagaaaatatagaagatttaaaaaaatatataataacatataaaaattttaatgaaccacatattataataaaagcaaaagataataatttaacaaatcttgatgtaatttatcctcatattaaatattttagaggtcctcattttattagaaatatttctaaagaattatataataattataaaattacaatttctgatgattcaattcagttatttaaaaaaaaacatagcgctgaattagacgaaattattgatataaatttgatatttaatactcctgattgtaaaatatgtggtaaaaattctttacataaaaataatagaattataaaatttacagaacaaaaaataattttatttaagagtggaaatccaagaaattgtaatacattaaaatatgattatcctacgttatcaggatatgaattggctaattttataagagatttaaatattattaaaaagatagattctgatgcatatgtttattggaaaaatggaaaatgggcaatcgttgataatccttatatttttcaaggaataagtaatatgatattagaaaaatacagaaacaatatgttaatacaagatatagattatattataaaaaaattttttggagaagcaaaaaatagaataagtgctaacttatctatgaatacagatattatttgttttaatccttatattatacaatttaataatggagtatatgatttaaaagaatctaaattttatactggcgagaatgcaaaaaaatatattcgtctaaactatattaaaattgattataaagatatagaagatatgtctgatgaagaaaaaattaaatttgaaaataattataatattcttttaaaattatttaatttagttattcccaaatctaatcctaaaaggatagtttttgaaactaatttatcgtctgtgttacattattgtcataaaagtgttataacaatattatatggtccaacttctggaggtaaatctactattaaatatttattaagacaattattgtttgacatgtttttagaacctcctatagaattttatcaaaattatattccaaaaaattcacccaactcttggttaggtaaagtagaagataaattagtttcttttgcttcggaaggtgatgttaatcgaaatgaagtatttctaaacaaaaatataaaacaatatacagaacaatatattttaggtagagatttaaataaatctaaatgtgttcacaaaaatacattaacacaatttatagatttaaatccaaaacctatgtttagttcagtagatcctgctttggtcaaacgtattgcagttatagaaataaatgagacgcaattcgtcaatgaaaaattatcacgagatactgtcaatataacatcagataatagaaatatagtaatagcagattctacgtttgacgataaaattttaaataatgaatttacgctaccgttattttatattctgaagaaatggtctaaaaaataccataaagatactgtcaaattattatacacccctgacttttttgataaacaaaattga

SEQ ID NO: 41 - DNA, 1885 bp, Amsacta moorei entomopoxvirus
  exon (1)..(1885)
atggaagaattatattcattaataaactacgcatattctaatgatattaaaagaacaatagtaaattttagattttcgattgataataaaatatataaaaatttattttctaattttcgcgaagatataataattaataatgaatattctagtactaaacttaataatattaaaaacatagtagaagttagatgttgttataaaaataaaaatataattaatttatcgttgataaatcccgaaatatataaaaatattattaatataaataataaaaataataaaaaaaaatgcattaatattaatgccattaaagaaaatgaaaatacacaatatcttaaatattatttaaataattgcaatactagttttgattcttttattaaaaaaaaaaaagaaaagaagaaaactttaataaagttatttaataatgataatgtgcataatatatcaaataacactaatcatactagatattatgaaatagagtctgaatataataacttaacatcagaggttacaataaaatataaaataatattagaaataattaatgaaaaaattattactgaaggtagattattattaccaaattctattagtataactgtttcaaatagatcaagaattatattatatgataataataaaatacagataatattatcaaaagataaatcagaaaataatatgcaagattttaataatatatgttctaatatattaaaaacattcttctctataacaaaagaatacacaaataatgaaataaacgaaaaacacataaaatcgcttagtatacattgtgattttaattatactaatagtatattaaaatacccaatattttttgaagataaaaaaataaggttttttggaaaaaataaaattagtataaaatccataacatcaaaatctaaattagagaaaatttacacatatatagaaaaaaatatatgtaatatacaaaaattgtatgatgatatagataattgtgatccgataaatgatcccattgatgatataaatacactagtaaataaaatatatttcaataatttattgaaataaaataaattaatattaaattataatggatttaatagaatacgacaataatcattatattgaacctattgctaatagaaaagatatatatctaaattttgtaacagcgcctttggtgcaagatatagattgttcattaataaaacatgaggataatatttatgatgttactaaatattttgtatttaaaacatacaattacgaagatatatatatagtttatgatgtgttattaaacaaagttgtattatttaaatttaattttacaataaaagaatatataattataaataattttttaataataatttataatgacaacgataacataataattgatatcgaagataaaaaatatataaaatttaaaaaatggaaatctttattactaaattgtacacaaatagctaattatattaaattaatagaagatgaaaataaaaaaatatttgttaaatatataacaaaaaatgatattttaatagataataatactattgataataataaaataaaaaaatataataaaataaaatgtattaatatagaaaataaagttacattatcaatattagacaataataatgaattatatataaataataaattatttaagctagattacaatatatataatatatttaatttttcgttaaaacatgtattattattaacagatatagacgatggaaatattataattttaaatttagaaaatttagaacaagatgaatacaaaaattattatgatataatagtaatgataaatgataagttttataataatatcagaaacgcatttttagttaatgattaa

SEQ ID NO: 42 - DNA, 789 bp, Amsacta moorei entomopoxvirus
  exon (1)..(789)
atgctcgatataaccaaatctattatatcttcgggtataaatataaaattaccaagtgttaacataatacaaaatataaaaccaaaatattataataatagttctcccaaatcatattttgggattatatatcatttattgtcaatagttatagaaatacaagacacatataaattaaatgataatataggatattttacaaaatatgatgatatgaagaaaaaaaataaaacagattacgattattcttataataatctttttaaaacagatattaaattagaaaaaagtggttcatcgatgaagaattggacaaatatatataatacaacagatgttactattgatatattaaatccgttaaataaaaaacacgataaactatctataagattaccttgtgtaatatctacatctgttatacattatttatatattttatcatatatttatgaatcagttacattaataaaagaagatttgtggttaaacgatagttttatagttaaatgtgaaaatttaagaacaaataattataataatgtaaaatcgcagttaaaaacaattgtatttaatgaaaaaacaagacaatataaaatagacggattatttaaaaatttcataatagacgaaagttttaaaaatataataagtaaatttattaatgatattcaatgtgttatatgcgatctatggttaactattcaaaaaaatataaatgattcaccatctgatagaaaaaaaatttattgggaagaatatgataatattttgggatttcaaaattga

SEQ ID NO: 43 - DNA, 2304 bp, Amsacta moorei entomopoxvirus
  exon (1)..(2304)
atggatataacagataatagttatgaatattcgacaataaacccacaagttatatttttatttgatgaaaacaagaatgttaaaaagacaatatttttatctaaagatagtataatagataatagttttgcatatggagtatataattatttattatctacaaatacaaaatttctatcacaaccagaatatattaatgatcatgttatattatcattcaatcttgaacaagctagaggatacattagaaatatattaagaattaacgaaaatattattttattttcaatatggcataatttagattattattataataacaatgaaatatttgatccatataatataaaaaataatttattaatagaatctaatgataataaaaaaatattatatatgttagatattagtattactaatggtgctatattttgtgttactactaacagttatactaatacaaatttagctaaagaaggcatatattcaaaaatttatacagaatatatacaagaaataatatttaatatatataaaaataactataaattatcttccgttgtaaaagaatcagaagaatattctttaacaaataattttgatgatataatcaaattatcaaatattaataaatataaaaagacattatgtattggcgtatatgataaatattatataaagggtgataaaatatcaatcttggataactacaacgattcagaatatacatcattatacatatatatagatcaaaataatataataaaaatcactaatgatgtattaataacagaaaaattaacttattttacagatatattaaaagaagaagaaataaaaaatataattattaaatcaactagtccaaaaagtattatatatatatattttgatacgtttttagactctaatataaatatacaatatgatcttaaattttttctaaatgttacaaacactagaaatatatttatagatatgtcttataaaattaatattatgacatctaaaaatcacatatcatttagatcttttaacatagatgtaaatttatgtaaatatttatcgttattgatattaggatataatcatatttttaataaaatacaaaaacacgctagacttaaaaaaattgatgagctttatccttcgaggtattgtcaaaattataaagatgttaaaagacaacctgttttaatagattcgatagatgaaaattatttaattaaaatatctgataaatattatgtgggtaaagaagatactacaaggacatatcaacacaaaggaactaaaaaaatatttgatccatacaaatacggtgatgtttatatagatgataatggtttaatatatcaatgttctagtatttattattcaaatatgggatttttgaataatatatatttagctagtggaggaaaaacttgttatccttgttgttattcaaaacagaaaaatagagatgaaatattcgaatcttgcgtttataataaagaaattattttagaagataaaataaatcccataatagttaattatggaagaattatattaagtaagaatggtttatctaaattatcacctaaattaaataatattttaaacgctaattcaaaaatagatattgttaaacatactaatagaatagatttttcagataattatacaataataatgtcatatcaaccaactattactataagaaattttgatgacatgtattattttattataaacaataatgctattgttattaatgataatatagtttatactgataaaagtatattaaaaatgaataataataatataaatgtatttataataatacaaaatagaattcatcaattaaaaaatattgataaacaatcaaaatatgatgatatagtagttaataaaatagatgataaaaaaataaaaataattaaaaaatactttaatataatatccaatatacgaaatccaatatctaataatggaatttctataacagatgatgtttgtactatagatggtgaattaatagaaaataaaaatattaaatatttttctgaatataataatatttctttaaaacctaaaagtactagcgaatatatagaaaagtattttaaacaatattttgatactatatatactaataatattagattatttataaaaatatttataacgaaaataatgcatagtataaaagaaacagacattataaaaacagattatactaaattagaagaaaaattaaataatattactaataaacaaatgtcatctgttatattgtcaaaaaaaagtatttaa

SEQ ID NO: 44 - DNA, 318 bp, Amsacta moorei entomopoxvirus
  exon (1)..(318)
atgttaccaaaatattggggaagaggagcgtgggttgttatttttacaagaatatattatacaatttctactttaaataaagaaaattatatacataatgttgaaaaattaaaattaatattatatttgatatgtagtacattaccatgcgaaacatgtgcagctgaagctaaaaaaaaaatacaaaaaaataatataatgtctgaattaaatattaatagaattttacatttttatatagaattttataatatatttcataataataaaatagatagaaaaaaaataaaaacatatgatacttttaactatgtataa

SEQ ID NO: 45 - DNA, 1703 bp, Amsacta moorei entomopoxvirus
  exon (1)..(1703)
atgaaaagaacgtttataccatttagtaaaactaatatagattcagataggcctaatatttatataacagaaactaaaaatggtaaatataacataccacaatatgtatcaagtccttgtacgtttcaagatggttatgcagtagcttctataacagatattaaattagaaggctgtaataattttggattaaatataactttgcctgaaataaaaggtataggtggtgttaggtttcagaattatttcattcctaaacttatcgaagaatgtattatagaaactatcgatgataataaaactaacgaaataattagaaaaactgggcttgaatttttaatggattttatacagaagaaaaaagaatattcgagatttgtaggcaataattctgatttatgtaaatttaaatatggtaaagtgctgatgatattatttttccatctaaagaagtatattttcctctaatgtttatatttgataatgttaatatgaatcccagaacttgttttagattattccctgaaactaaattacaaataaaaataaaatttagaccatttgcagatattttattacccgatgtaaaatataagaaaaatagtcttaaaaatatttcagatgttgatctacaaccatatataaaatttactggttataatacgtgcggaagtccttttaaacatagatatatagaagaattaacttattctacacacaaaagtaataaaaagaattattattcacctgaatttttatctataactaatctattatggtattctaaatctgatattttcagaggaaatatgtttatatcatatcccgattatccagaaacagaagaaaattttatcaaaacatacgttgataaattattaaaagatcttttaattatttctgatgatgaaaactttattaaatcaaaaggatttagtgataaatgtaagtttaaaaaaattgatccgtgtgataaaattgtgtttgatgttaataataattgtgaaattaatataatgaatgtcccggaaggttttgatttatattatcatacaaatatattatcattcagtagaagaaataacccaaatgattataatatttctaaaaaatttagtaaaatatctggaacatatatacctaacgaagataagattttaatacacgaagtaaaacatacaataaacatatctgacgttagtattccattgagtatatggaatgcaaatgagaatacttctacgggtgatttgagatctattaaatctaaaaaatcagatatatatgtaaatgatccttttgtttttggattagattttttatcaaaagaattaggaattattagcagatctataacaagtagttctaatgaatcaatagctgaatataacagtgataccgtaaatattgaatcatattttcaatctgataatttatttgcagttacgccaacatcagaatattcaaacccagcaatatttttacatagatttaatcttcataatataatttttattgaaccatctagattaatagccgatgctgctaaaaattttagatgcgttaatttaagtatagattggaaagaatttcctgaagtagatccaagaagtttatttaacaaagaattacaaatttgtcaaactattgttaaaaaaatatcatatgataataatattataaccgttcatattctagagtaa

SEQ ID NO: 46 - DNA, 2619 bp, Amsacta moorei entomopoxvirus
  exon (1)..(2619)
atgtctatcgacgtttctgatattattaatgattgtataaaattttatagtaatattaattttgatagtaatccaaatgttaataatgaaatagaatttacatacataaatccagatttaagaattttatctaatatttatactgataataatgaatctaaaaaaaaaacatatttagaatatgtacttaaatttgctaacaaaaagtctaaattaagacaaaaatataaatatgattatcctacttttgaaatagcaaattcatattttttagataaacttactaataattgggaaagaaaaactataatatcagaagataaaataaatattaataaaaatgaatatattttattgagacataatactgaatatcaagataatgatatagaattaccgttattaaatgatatattggataaaataaatgtattatttgtttcgcaattatatataattataaatgatttaataaaagttgaatttaaaataaaatcaaacattggaccattatcgtcaaataaattattattaagtacacatttcaatgatatagaaacatatagaaaaaatataacatattatttagaaatagaagtactatctaaaacaaaattggataataatgtactttatgataatttagtaaaatcttttgaatatatatataaaagcaaaaatatatctaatataagtttagttacaataaaaaataaacctaaaataaaaacacatatgatacaatataataaattaaatacaattgataaagaatcatatattatggctattaaaattgatggagatgttgtagaatttaatgttatgaatggaatttgtaatatcataatatatgatatggtatataaaaatttttcatgtaacatagataaaaatatacaaatgataggtatgggagaatacattaaggtagataatgttaaaaaaatatatccattttatttttcaaaattatcttataataataaaaaaataataaataatattctagatagatataagcaaatacaatattataatgataatttattgtgtcataaaccaaatatgcaaattaaatttgaaaacaaattaactttaaaatttgacgaaaataacgtaactacaaatgtactaaaattttataaatcaatagaaaatagttcatttaaaaatatatacgatggtattgtattactagatattacagataatgattctaaaaaagattataaatttaaaatagataatactgtagatgttatatgtaaattggacacttatagaggaacatatatattacacaatgataataaattatatataacttttacattatatcaatatgataataaaaattttacagaaattttaaaatacgaagaaaagaacgaaattatagaatataataattatgttaacttattaatttttaataataataataaatttggtcctaaaaaaatgttatcgcccatatggtgtattgtagaatattcatttttagaatctaaaattattggattaagaatcgataaaactaataatttctatagacaaaattataatggcaataatctagatgttatattaacatccaaacacattcacgaagaatttccatcaaattataatattgattatttaatgtctttaaatgaaactataaatgtaatagataataatccacacagatccaaattattattaaataaagaagttaataaatattttatgaataatactattagaacatctataaatatattaacaaattatttaaaaactaatggtatatcgatggctatatcaaaattagtaacaactttaccaaatagatatgttttaagtatagatataggaagaggaggagatttaactaaatattattatgtcggaataacaggaatgttaggaacagatcctgatatttttgctataaaagaagcaagagatagatataaaaaattacaaactatatcaaatgcccaagctagtatatataaatttgatagtttgaacatgtctatattaaatgataattatgaaaatgaaataaaaaataaatttatgacacatcacaaaatacaatattttggagttatagagtggcaattagctattcattattcttacaataacaatacaaaagatatgatattattaaaactaaaaaatttatcaaacgatggaacaaaagtaataataacttgtcttgacggagacgaaataacaaatagattaaatgaaaatcctaatttaatttataatattcaacccggaattacatataaaatttctaaaatttcagatgataaaatatcagttttatataatgctacaatgactgaatggttagaagaatatataataacagataaaataattgatgattttgctatgtataattttatattatcagatgtttgtaaatttgatgatatatttaaatataattctgataaatctgtagaagttttatctaattttttaagaaaatcaactaaaaagttttataatgatattaaaaatgataaaaatatatataacaatgatgatattaaaaaaataatgtcgttatttaaagtttatacttttgtttattcatcttgtaaataa

SEQ ID NO: 47 - DNA, 3450 bp, Amsacta moorei entomopoxvirus
  exon (1)..(3450)
atgagaaataataaagaaaagtatatgaatcattttacggattttataattcgtaatttaccatttagaaatttaattgattcgatgaaagaaaatattattattaataatgaaacatataaaatagaagaattatttaaatatatttattatcatccactagatttattaacaattagagacattagtaatgcagatagaaaagatgaatatgttaaacaatttgtaaataatttatatcttagatatgcatataacgaaatggattttataaaaaataatataagatatgacgataaagtatattctattataaacgaaattaattattttccagaacatacttcggaatttttaaaatatagattatcacactatgaatcagaatcaagaatcagaggaggaagagtagtaacttttagcggtgttcctgataatggttatggttatttattaagtcaatcagacccttcatctaagtatatatgggcaatagtagataactatttaatgattgataatgaagataaatttgatttttatacccaatatattccatttattaattattttctaaaattatattataataacatcacaaaaaaatatattattttagatcctagtaatcctgaagaaaataaagatgtacctaacgctaatttaatcgacgaaagtttaaaaaataaatataataattttacaaagaaattatcatattttgatatatcaaatagtagatataattctataaatgatgtgggtgattttaataattatttagatatcaatactaataaaaatattattgaaaattatgatgtaattattaataatattataaaatcaatatatctatataacataatggatacaaatgtagaagatatattaaatataataatgaacgatacaaattatttattattgaatgaaatatatagtgaatatttaccaaactcaagcaaattatatgttttagtgggattacgtcgcattatatatgaaaaaagcaaacaaaataaaaatattagcaatttatatatgttagattcatttgtaagtatattattatatttattagaaagatattacgaaaatgatataaccacacttaatgaatctaaaagattaataaaacaatattataaagataatttaaattcaaaaaatagcgttaatttggattctataaatattattaaagaaaatatcaataataatattattaatataacattagatgaagatgaacaatcaagatataatttaataatagccacaaacccagaaataatagtaaattatgcaagtagaaattattttaacatcagtagtaacgaagataacacatcaaatgtgtataaaaaagcaatggcatttttcataaataattttattgaaaataatataactaacgaaaatataataaataatttatcacaagtttatactcaaaatacagattttattaatattacttatgatgatctaaataatttaaaaataaaatatattaataattataatataaatttagatattaaaaaaattattaatgacaatctagaaataattagaatttataaagataatgttttatatgacactaatattaaaatgaattataaatcatttatatcactattacccaccatatactatattattttttataatcaacctataaatagaaaaatatatagaaaagctataattcaagaacctccaattgaagaagagatctcaactgaaactacaaaaagagctagaagagtgagatttaatccatttaatgtcgaagaaacaataatagaacccaagagtgtttttgttaataaaagtaaaaattatttatatgatacattattttggtctggcatatctatagatgattttaataaatttccattatacattaaaactattatcttggatagttgtcttattttaggaagacaaataaacgatgatgggtcatctacttgcgttttatatcatgatattaataataacgatgttacaaaaatatgtataataccttatccttatacagcaaacagaactatgtatgatgtttttaaacaagtttcagataaattaagatctatgtactcatatcctgtaaattataatataaataataatgaaaaacatttaaatttatcaaaaaaaggaaattataaatttatgaataaactagcagaatgtaaagatattaaagatttaatacaattttatgttatggtaagagatacagatccaggtcattctgaaatatcaataccaccaaaccaagaattatatttagcaataactttattagatttattgggattttctcctactttatcaagaagaaatactagtattggtttttcatattacattcaaacagatagacaagtatctgctcgtaatttgatatatatattatcaagaaactacccagatatggtaaaaagtaaggaattatcagatgtagtaattaatatattgtcgccaatacttgcatatttaagatatgtattaaattattatagaacaaataatacaacattaacagctggatctaataatgcaggtcatgattgttgtattcctattaaatcaaatcctttagatttacttattaatatagatacatcttttactgattccgacaatatattagatataatgaatagagatatgtttaatttggataatgatatatttagacaagtaatacaaaataatatttatagcgctggtagcgttgatattgtcgatattataactgataatattccccaaaacatttatatgaaaacaaacataattgataaaatgtatgataaaatttttgctggtgaaagtattagcgatatattggatatacagtttgatgaagatattaatgataattttaattacaatgatgtaaatatgattactaatgatttaatgaaaaaactaagaaaattattaaaaaaaacaactattaataatttagaagacaatgctatgatattaaagtcacaaatgttatcatctattaataatgtttttaatcgttattcttgtatggaaaaaataccaacacaatatcttataaatattagaacattattaaaacaatatagtaatgaaaatataaaaattgacgaagatttaaaaaataatatccaaacaataattagtaatatccatagtaatactaaagatataattaaaattattaccactttaagtgctggtattgatttagttagagcattaaaaagatctaatgcaaatgtagaaaataaaacaataaatcttgaatttctaaaaaaattatgtgatatttgtaaagatagtttttataaatataatagaaataatgatatagtatataaaaatttactaaaagatgtatttaataatgataatgaaattaataatgatagtgtgtttgatacatgttaa

SEQ ID NO: 48 - DNA, 2007 bp, Amsacta moorei entomopoxvirus
  exon (1)..(2007)
atgaatgtttttgaaatggatagtataaatatatctaatcgtaattatttaatagcaggtgtaacatctgataatatttgtaattgtgttaatgatagtgctatggatgattatttatttgatacattatctgtagatagattagatggcggatatataaaacacgaatgtggtatagaatgtgggtgttttaatggtaaattaatggctagtatggcgacagaaatgtcaagagataatttaatagcatcgtgttctaaaagtgcaggagcttctaatgtaaaatcatctaataatcaaaatcaaaaaaaaagaaaatcagaatctggtaataaaattcaaaaacaattagatattatgaacacaaaagaagatcatattaagaaaattgctgaatatgtagctaataatttaccaaaatcacctttaacatatacagttcacgacattaatagattaattatcacatctccttttaaggatgttattttaaacgaaaatgatatgaaatctataatcggattggctgcagctttttataaaaataaaacaataaatcattcattattatcaactattaatattaatacaaatgatcttattcaacaattaagacaagtatataatttatcaacattagtagattatgattcatttttaaataatttaaaagtagccagtgtggaatatactgatattgcagattgtaatgattacattaaatatgtgccagacgaacctaatgttccatcaatattatttgctttattttctacaagaatacctgtattatttgatattgttgtaaatcaagatttatttaaattacaacaagagttacagacagatgattatagcgcatataaaaatatatatctattgctttttagattatctgatagagaaccatactattcaaatcaatctggaggacttagtaataaaattgatgtttatactgaattaagtcgtatattattatctatgtcgattaaaagattaatattaaaaattattaaaggcacagttacaggaaacacagtagctcctataatgaatatatttaaaaatttatatattaaaaatgtcagatcttctcaagaagctttattatcagcaattttaaaaatatggtcatatgctccaacaattgttctgaaaaatatatcatctgattttagaacagaaactgtattttttgttgaatatgaaatatctgaatacaatcaatttgaaaatcaaaatataaaattcactcaagaattaatgaaatatatttattacgatcctattgttaataaagttattttgtctcctaaatatattttggattcgataggcggaaacacaggtatgcaaagtataacatattgtaatagtggttttagaagtattaatcctatgacaaatgtagctttaaaatcaacaggtatgttcattttatctatacctagattaattaaacaatcatattcttatggtttacctgacgaattttctgatagattattaactaaatatgtagatttagatcaaaatattaccattggttgtaatatgtttcaattaagagcggccgtttgttacaaaatatcaaaatatgttgatttagatacatgtatacagaatcctatatcattaggaacagttgctattgtaaaaacacaaaaagggtggattagatataatccagatttaatgtattcttgtaacgaaaagaaagatttattagataaaatactaagaaatgaatataaaaaatcattgaatttaaataattatgaagttaatcaatatttagataaagattacgaagaatggaaaagtactttttcatctattaataatattatcgataaatttgaaaaaggttacgtaagtacagattcattaattattcaagaggcagaagccatcgatataattagtagatatggaactattataatatacgcacaagaatatactaatggtgtagatatgttaccactgagaagatattattaa

SEQ ID NO: 49 - DNA, 723 bp, Amsacta moorei entomopoxvirus
  exon (1)..(723)
atgtccgaattcgattatgataaactgcgtgctaaaccatttaatatggcaattataggaaaaacaggatcaggtaaaactacatttttaaagaatttattattaaaaattggttacggattttataaatttatatatttaattactagttctgaagttaactttaaatcaaatgaatattttaaatttatttatcccaatcatgttttttatctttattcgaataacaaagacaaggatgttaaatatttattacaagcatatttagaaaaaattaaaaattttagttttgaaatgaatcaaaagtgtgaaaattttagaacattagttatttatgatgatattggcaaagacacaaaagataaattaagtaattttacaaatgtgtgcagacattcgttagtatcaaatatttttctagttcatagattagaacatttagatacaactacaagagatagtttatcatatcatgttataaattccgaatcagaaaatatggatttaataccttgtaataaaaatctaagaaattcattacttgcatctgtgataaatatttttaaagatcgcgaacaatcaaaatattatatatattgtataatatatgattctgtatcttattcttgtttaatatcagacgatgatttagaaaatataaaaaatgaagataaatatgtattttatactgattccgtgattaaatctcatatactaaattaa

SEQ ID NO: 50 - DNA, 1407 bp, Amsacta moorei entomopoxvirus
  exon (1)..(1407)
atgagtaatattgaaatatatgatatgtttgaaggtgataaggaagtactatttatagctggttcacatataaatgaattaaaagctgataaaaatttatgtagtgaagttataaataatgttgttaatgatttttcgttttctaacattgaaaaaaactttaaaaatataaaaaaaattaataaatttaaatataaaattattaatgatattacaaatgtaactgaaacagattattttaaaccatattttaaaatgaaaccatatatggctaatcaatatatatatcatatacatactggaggatatggcatgactgttcgtattaatgaaagtttttgttttaaaatatcattaaatccaactaataatcagatacatgaatttgtaatacccaggatgttatctagtattatatcttattcaaacgcagacaaattaatattattaccatatacattaataaagaatataaatttcaatggattgatatatataataagtatgcataatataattttattattaattaattttatattagataaaaattatagtaatattgatatatataatacatatttagattttaataaaatgaatagtatttatagatctttaacaaaagatgaagaattattatataaatgttttacttatttttataaaaaatattttaaaaatatttttaatgttataatgattaataattattcatcaataatttattatttaagtactattaaagatttattaactaataaagattataaagacaaaatatatggatctattataataatgcctttagctatatgtgcgtcgaatgagttgaaactttcaatatataatgacacatatgttccagatatgataaatggaaatattgcatatgaagtaaataatagatatataagacatattgtattagttgttttattattaatatgtataccaaacaaagatagaatgatattttttcacaatgatataaaacccaataatatattagtttttcctaatgtaaataaagaaaaattaataataaaatataacaataggaatataatatttaaagaattatatatattaaaattaacagattttgatttatctagaatagaaggattagataacaatagaattaaaaattctccaatattattatataataacataattaacgatatatattattttttttatagattaaaatatgatttttttttaaatttaaaaacaatagatccagagttaaacgaacatatagaaaataaatttttattaaaaaaatatatgaaagatactataaataatcataattacaaaggaaatgaaaaaatgtctataagttttgttaatgatttcatatttaattctggattatttaattattggttagattaa

SEQ ID NO: 51 - DNA, 714 bp, Amsacta moorei entomopoxvirus
  exon (1)..(714)
atgtcggacgtcgattatgatgatgatcaattggagcctagcgatgaagaagatatggatgatctagtgtatagtgaagtttgtgcaaatgatgaatctgacgaatctgaaataaatttattagatgaaataattaacgaagaacaagaaatggaaataattaaaaaaataaaaaccaaagataaaattaaatattttaaaggtaaaattatagatatgaataaaataaataaagcaaaagaaaaatatttatataatataaaatttaatgaattattgtctatatttctaaattatactaatattttacaaagtggtggattgccattattagatgaaattaaattaaaaaataattataatattgaattattttcaaattcttctacaacaccagaaacagcagcaatgataatgttaataattatgaatatacctatgtgtgttaaaaaaaacaataaaatatataatagagaagtattaaatatagataaattgaatatcgattatataaattgttattaccaaaatgtaaaaaatatgttacgatgtgttacatataattctaataataaatttgattttaataaatttaaaattttatttccgttatttatagaatatataaatcgtgatgaaattagtaatgaagaattagatgaaattaaaaatgttaaaagaattataacaaattatgattatgaaaatttataa

SEQ ID NO: 52 - DNA, 246 bp, Amsacta moorei entomopoxvirus
  exon (1)..(246)
atgcaaatattcattaaaacattaacaggtaaaacaatcacactagaagtagaaagttcagatactatatcaaatattaaaaataaaatacaagataaagaaggaattcctccggatcagcaaagattgatttttgctggaaaacaattagatgatagcagaactctttcagattataatatatctaaagaatctactttacatttggtattaagacttagaggtggaacgaatataaattattag

SEQ ID NO: 53 - DNA, 2013 bp, Amsacta moorei entomopoxvirus
  exon (1)..(2013)
atgaataaagttatattagatgatttgagaaatgataatattccgaacaatattgctcaaattttgcctcatcagttagcaacattagattttttatatcaaaaatgtataaataatgctaatagtgttttattgtttcataaaatgggttctggtaaaacaattatttctcttttgtttagcatattaatatgtaatattaaaaaagttataatagtattgcctagttatagtatattagaaatgtggaaacaaaatttatatagatctttaattttacttcctaataaagaatataatttacaaaatattgaatttacaactagaacaaaattaaacgaagatataatgttaataggtaaaactgatataataaatgaaaaattaaaaaattataacgattatattatgataatagatgaagcacataatttttttggaaatatgacaggtagtgtattatctactctaagaaaaaatacaaatataatatatgttttattgacaggtagtccgataacaaatactgtttcgacaataaaagatattgtggaattattaactagggaaacatttgatgaaaataagtatattaaaataggtggaaatcgtgtttttgaaaaaagtataaataacgaaggtattgcatttttaaataaaaatctaaagggtttaatatcatattatgatgaagagaggaaagatgttcctgaagtaaaatacagaggtaaaaaaatatttctatgtcctttgacattatgtccaatgtctaaattacatgaagaaaattattatgaagtagctagaaatactaaaaatgatatgtttgttaaattattaatgagtgtttcgttggttgcattaggatctatatcaaattatgaaaatttttcacaatttatggagacagataaaaaaatatttgataatttttatatttctaatggaaaattttcaggatctgaattagttacattaaatatatcttctaaattaaaaacttttagagatactatatttaaagaaagaaatgttggtaaacgatttgtatattttgctaatagtactataggaagtgctataataagaagtgttatgttagcaaatggcatatctgaatatggaaaagaaattgttaataattttacatgtgttaattgtataaaggataaaatttgtcacaatggagaatgtattcctatgagatttgtaataattacatcaaaagaattaaataaaggaaatagtaattatataaataatattttaagtatttttaacgaagatattaatgatgatggaaataatataatgtttttatttggttcaaaaattatatcagaagcttatactttaaaaaacgtaaaagatatatggtttttaactgttcctgaaacaaaatctgaattagatcaatgtgtagctagagctgttagatcattttcttataaagatactaatacaaaagtaataattagaatatgtattgcatcaacaacaaatacattaagtaacgatgtttctaaaacaattgaacaatataaagatgttaatatttctgatgtttataaaaatactttattaaataaaattgaattattgttaacggaaagttcgtatactttatcttatgattttagaaaacaattatattctgaattaaaatttgaaaaatctaaagtagctgataatatatttaaaaatctaactattttatcttcagataccatcgagagtgatgttttggaatgttttgttttagaaaaaatccgaagatattgttattacaatacaagatttaaatttacaacattaaacgaatatataattaaaaatatagatattaaatataatgataaaataaaagaatatattaataatgctatagaatcatcatttgttatagaaaatgatatatttggtaattgctatttaacatattttaaaaatgatattgttacggttcccatagtattagaatataataatcatctattatcagttagattgtga

SEQ ID NO: 54 - DNA, 1395 bp, Amsacta moorei entomopoxvirus
  exon (1)..(1395)
atgaataataaaattagaagatttccaaataaaaatttaaaaatgccagaatctggtattaattttatgtctatgttattttttagtaaaatagataatatggtatattttataaatcctattaaatataatactaatgcaaatatagctatattagaaaaaatagatgatgatgatgaaacaagaggtaaagtaacatttatacctataaaatacttggaaatattatataatgaattagttttagatccaaatcatattaataatattaattttgaaaataatattaaaagaaaattttttctattttggactataaaaaaatatttacaagataaaaatataaatattaatacttttattacatctaaaaaatataaaggcattccattagtatatatgagaaagtcttttctaaaatcagaattatccaaaacaagagatttttctacatttgccacaatttatgatgatttggatgctcaaataggaataccgcctttgggatttaatcctaaacctaaagcttacccaagaaaacatgataaatctacatggttaagttcgggagatatatataattgtatatatccattaactatgattaatacagattatgattattttcatttgattttatttgaaaaaactgataaaaatattgctacagtagcttcatctatgagatgctataaacttgaagatagagtaaaattttttttaatgaatgataaaaaaagattttttatgtttcctataatttataatgatcattttacttgttgcgtaatagataaacactttgataaagataaaaaagctgcatacttttttaatagtagtggttatataccagaacttataaaacaaaataaaaaatatatgtttattgaatctgatatgactataaaaagccataaacactacaatagtactcctaatactaattatgcttatttatacattgatgtactatcagaatatttaaatgatatatttaaaaatgtaaattattacttttttaatacttttgaattacaatatgatagtcccgattgtggtatgtttaatataatatttttatattatatagtttatttcaacataaaatctaaatttgaatttaaaaaattatattattctatgagttttattggtgatttattggctagtagttatagaggtgcattatttatttctagatatgatattaatagtattgacgaatttaaaaatacattagaaatatttaatataaaaaataaaaagtttatggaattaatagatatgtataaaaaaaatagtaatagaattatgaatgtatgtagtaaaataaaaaatgattatgatagttatattgataatgagaagaatagtttagaatctaatatttaa

SEQ ID NO: 55 - DNA, 1947 bp, Amsacta moorei entomopoxvirus
  exon (1)..(1947)
atgtttgcattagattctattgttggtaaacatataaattatgcacttgataaaacacaacatttgcctaataaaattatgaataatattacaaatactgaaattacattacaagattatcaatattttgtaagtagaatattcataggattaaaaaatttgaatagtatgttattattttgggatactggtatgggaaaaacattaactgctgtgtatattataaaatatataaaagaattatttccaagatggataattttaatatttattaaaaaatcattatacatagatccttggttaaatactataagatcatatatatcagataccagtaatataaaatttatatattatgattcgtcatctagtttagataaatttaataatatatatagatctatagaaagttctcttaataaaaaaagtagattactaataataatagacgaagttcataaattaatatcaagaactgttaaaaaagataataacgaaagaaattttactcctatttataaaaaattaataaaattagcaaatttcgaaaataataaaatattatgtatgtccgctactccagtaactaataatatttctgaatttaataatttaataggtttacttagaccaaatgttatgaatataaaagaagaatatataaataatggaaagttaattaattttaaggaattaagagaaacattattagctatatgttcttataaaagattaatagaagcagatagtttaacagaaacaaattatatagatggatatgcaaaaaaaaatatattttatcataatataattatgtcagatgagcaatctaaattatataatatggcagaaaaatatgattataaaactgaattaggtggtttaaaaactatgagaagattaatatcttcatttgctttttatgatcttaaaataaaaggagatttagataatatagaatataatgatatgattaaaagaaaacttgctgaattttccgagtttacaaaaaatattaatttctctgaatcttttattgaaagttttaaaaatgataatataaaaataaaaactaatttaccaatcactgatataaataattataatatattatatcaatattcgtgtaaatatatagaaacttgtaaaataattttaaattcgagaggaaaagtattaatatttgaacctttagttaattttgaaggaatatcaagtttaaaatgttattttaattgttttaatatttcttatattgaatattctagcaaaactttaaaaactagagataatgaattaaacgaatataataattatgaaaataataatggtaaaaaagtaaaagtttgcatattttcttacgctggatctgaaggcatatcattcaaatgtattaatgatataattatattagatatgccgtggaatgaatcagaattaaaacaaataataggaagatctataagattaaattctcataaagatttaccacaagaatatagatatgttaacgttcattttttaatatcatataccaacaacagaaaatctgtagataaagaaatattagatattataaaagataaacaaggtaaaataaatgttatatttgatttattaaaatcatcatctatcgaatctattcataacacatataaatatatagaaccagcagaaaatgaaataatttttgacacaatacgtaaaactagaatgaaagaaatgaacgtatctaatgttattattaatataaaattatatcccatatcatattgtaaagattatgatagagccactatattaaaaggtttattaaacaaagacacaaatatagtatataaagataatacagctgtagcaaaattaatgattgataaagacaatatacctatatttataatagagaatgatacattaatatatatagcagatgattattatgaatag

SEQ ID NO: 56 - DNA, 453 bp, Amsacta moorei entomopoxvirus
  exon (1)..(453)
atgaacgtaaaaattatagaaaaatatcaacattttaaagaagataaatatatatcatattataatatatttatatatatactagaagaatatattataatattatataattataaattaatatatataataaataaaaattatatacaatatatgtattataattatttatttaaaaataatatatattataatttaaaattatataataataataaattattaaaacataaaccgtcgaaaaaagtacgcttttcatccgaaccaccaaaactccacattatgtatgtttggttatatgctgcaaaacaaactcgaaaattatactgggataaatttgcgattgatagacatagattcaaaagaagaattaatgatatagatatatcaatatcttgggttttaactccacatcacagacataaaattatgaaacatcttaagttaatataa

SEQ ID NO: 57 - DNA, 900 bp, Amsacta moorei entomopoxvirus
  exon (1)..(900)
atggacgaaacaataaattttaataataaatcatgggaaataaaaaatttaatagctaaaggtggttttggaacagtatataaattatgcgaaaaaaatgataataataactgttacgctattaaaatagaaccatcggataatggtccgttgtttgtagaaatgcacttttataaaaaaataaataaaaatgaaataaaaaattttattgatgcgaaaaatttaagttatttaggaataccattactatatcataatggtattataaaaaaagataatatagaatatagatatatagtaatagattattatgaatttaatttaaatgatatattaaaaaaatatataaaattacctataataacaatatataaaataactatacaaatattatatatattagaatatttacacaaaaaaaaatatacacacaatgatataaaaaaaaataatataatgtttaattcatcattaactaaagtatatttaatagattacggactaatatataatatgaattctaatcaagaatataatataaaatgtagtaatgatggaactctagaatatttaccattaataactcatttatttggcttaaaaacatacatgggagatatagagtctctgatgtataatattattgaatggtatagtggaagtttgccttggattaaatataaaaaaaaaaatgttatattaaaaaaattagattttttcaacacttgtttaactaattcaccaattgaaatatgtaaattatataattatataaaaaatgctccttctatatataattataattttatacctgatcatgataaattaattaattattttgtaacttatttaaaatctaaaaatataaatttaaatgataaattagttttttgtaaataa

SEQ ID NO: 58 - DNA, 1599 bp, Amsacta moorei entomopoxvirus
  exon (1)..(1599)
atgaatcatattaaaaaaattttaaaaataaaaagtgataaagatatattaaattacatagatgcattaaattataatgatttagaaaatataatacagacattagataatagttattatgataaagaagctttaattagtgataaaaaatatgatttaataagaaattttataaataataagtatcctaatgaatctttgtgtaaaaaaataggttatactccggaagataaagtacgattaaagtattttatgggtagtgaaaataaaacttataaatcagataataaattattaagttggataaacgaatatcatactaatatattagtattatctgcaaaagcagacggaatatcagtattatgggatataaaaaataataaaatatatagtagaggtgatggtaaatatggaaaagatataacacattttattaattattttaatttttcagatgataaaaatataaataacaatgatatatttaaaaataatataaattttgttagaggtgaattagttatagataaacctgaaaatagaaatatagtagcaggtcaaataaatagaaatgaaattgataaagaaaccgcattaaaaatatattttgtagcatacgaaatattagaaccaagaatgacacaactcgaacaatttcacaaacttacagagaatagtataagaactgttaaatatgattctgttgattataatatttcatacgaacaattaagtgaaatatataataattatacgcaagaattatcgtattacatagatggtattataataagaaataataatttaaatccagttattaaatctggtaatccaccttggtcaatatgttttaaggaaacagataaaatatatattactactgttaaagaaatcaaatgggatatatcaaaaaaaaatatatatatacctaaagcaatattagagcctataattatagataattcgactattaatgctgttgcttgtcacaatgctaaatatgtaattgataaaaaaattaacactggttcaatagtagaaatagtaaagaaaggtggagttataccgataattaataatgtaataaaagaatcagatatagaaattatattacccgatggtattttatctggtgtaaatattatatttactggtgttaacaaagaaagtgaaattaaaagaatattatacttttttaaatcatttggatataaaaatattaataaaacaataattgataaattatatatgttaggatatgtaaatatattaaaatatttagaaaaagatattaatatagaagaatataataataaaaaaacttatattaaattattggaagtaattaaagatataaaaagtaaaaattataatatcgtagacatattaacagcattatctctagatagtatatcaaaatcaagagtttgtgctatttataatgagtttccagattttttgaaagataaaaatgaaaaagattatagttcaataaacggtattggaaaatctatatcaaaaaaaattaatgataatattataaataattacgaatatataataaatattttaaacgctttaaatataaagtattaa

SEQ ID NO: 59 - DNA, 687 bp, Amsacta moorei entomopoxvirus
  exon (1)..(687)
atgagcgataatataaaatgtaaatattgtaattcttttaacataataaaaaataaagatatatattcatgttgtgattgctcaaattgttatacaacatcgtcaaaaagaataacaacaataagtagtgcttcaaacaataaaactatacattgtaataatgttttaaaagaaatatcaaataccagtatttcatatgatatagtagatggttttctaaaactaatcaatgataataatttaaatacaaaaagtataacaactgcgttaggttctgaatatttaaaatcaaaaggtataaaaaattatagaactacgcataaattaattaatatgtctctatcggatggtaataattgtatattaactaaagacgatatctttagaattaatataatttttgaggattttacacaatttatatataaaaataattatacaaaaactatatcttacgaattctgtttagatagaatatttgatattcttaatataaattatgtaataaatttcaattatagcaaactaaataaaagagacgataaaccagaaatatggaataaatatataattgaattatataataaatcattgattaaatctaataataaatttatatttagaccaaataatattatttttaatgaatatataaaaaataatatatgtttgcgtaatattatttaa

SEQ ID NO: 60 - DNA, 3906 bp, Amsacta moorei entomopoxvirus
  exon (1)..(3906)
atgacaacttttaaatatactttgttagataatagcacaatagatgctattccaatagttattgattctattggaaatgataacgaaaatagtgtaaaaagtcctaaattaggcggaactaaattcaatgtgtgttcgacatgcaatttaacaagagaaaatggcgacatgggtcatccaggaagaactcctttaagagatatgtgtattgtaaaatctggttgtattaaaaatgttttggatacactaaatacattaaaattatgtaatagttgttttatgataaaaaataatacaatattttcagaaataattgaaaaatataatagcgaatataatattaatttaaaaaaagaaatattatcattattaaaaaacaatcgccaaggtggggtaaaatgtaataatgaaaattgtcaaaatataacaggaacatataaatataatcaaaaaaaatcatatttttacgtaaaaaaacaaaaagatgaaatcattcttaataaaacagtttatactatgttacttggaattcctgatataatttataaatgtgttactgtaccatacgcagattctcaattacaaccttataaagcattttacgctaataatattataattcctgtattaccatctagacctccaaattattttgataataaagaatctcatgttatgacaacaaaattgggtcaattagttggcacatcacaaaaatctagagatgaaagtgaagttcaaaaaatatataatgatattgataatgttaaaccaaattctccatataaaactagtaacatgttagttacgttaaatatacaagttggtggtaacaaaaaaggaagtatagttagatctaatataatggctagaagagccgataacacagctagatgtgtagctggtccaactatggacaaaataggatatatatatataccaaaaatagtggctaagacattaacatcatcaatatattataatagatttactgaaaatatgattaaagatatgttagttaatgataataacaaaattaaatatatattattatatagatatgatcaattaaaacccacaacattattaaaaataaaaccacaatctagactcaataatttattaaaaatgaaatatggagatagaatagaagttgaattagaagataatgatgtaatattatttagtagacaaccatctttacataaatttaatattcaggcaggtatatgtaaaatatgggataataatacaatagcaacacctacgccgatagcaaattctatgaatttagattatgatggtgatgaaatgaatgtatataaattaaaatcatctgtgtcagtagaatcattatttactatgttatctgttaatatgattaaaaataattataatttttcgccaatatttgggttaattcaagatcaaataatatcagtacatatgatatataatattaaagaattttctctacaagatgttatttatattttaggagaatatagttattatataagagatataaataaaaaaacatattctggaaaagaattattatcattattatttccagataatcttacatatgaaggtatgtttgataatggtaaaattacattatctaatatatcatctaaacaagttgtagctcagtcatatgaatcattttcaaatattctatctcaattaaaaaataatatttatgctgtgtattttatagatgtaatattatatgtagctagaaattttataaatttgtatagttttagcgtttcgttaaaagatattattccagatatatattttattgacgatgttcaagaatacattaataattgttgtaaagttatacaatatgttgcgctacaatattatattaaaaaagatcatataataaaattaacttatgatgaaatggaaaatataagaatacaaaacggtaataatataatatctaatgttaaaaataaaataaataatctatttaaagatgagaaattaaatactataatgatgatgaaaaattcaggctataaaataacattagatgaattagtaacagtgttgggttgtactggacaacaaggaattgattcagatgatataccgaaacccggaattatgggaagagtatttgattcaacattacctggaagtttagacatagaatcattaggatatgtaaaatcatcaactataaaaggtttaaaattcgaagaattggcatttcatacaaaatacaattcaattaaaaaaatattaaaaataacatgcgagacatcatcggcaggtagtattggtagaaaattagttaaatttatggaaggtgttaaagtagatcatttgggtagatccgtattaaataatgatattatatggtataatacaaatcatattaaaatgacaggtggtgatatatctaaagtagaaatattaactcctagtttagaaatggtaaattacacacttataaaagaaatatataacgaaaataaaaaatatttattaactaattttaatactgaaataaataaagaatttatttttccaattaatataaaattagagattcaatcattttataataaaaaatcaactcctatatctgatatagatgcattaaaattaattgatgaatttatagaatatgtctatattaatatatatttttacaacattacaatagattggtttaaatatattttatatacatatctagatagaaatacagtagaaaaatataataaaaaatattctaaagaattattaaattatataataaataaaattaaattaaaattactaaattcattaaatccaggttatcctattggattagaatacgcaaataatattcaagaaaaatttacacaacaatcattatcgtcttttcacactactaaaaaatcaggaacagcatcaacccaattaggattttcggattttaaagatactgtagaattgagtaaaaaaaataaaagagatattgtaattgcttttacaacacacagatataaattagaagatattaagaagcaaatggaatacttgtgtttaaagaattttaatccaaaaataaatatcatagaagaaactgaatctgatatggtaataagtgtaagtataaaaaaatactatattaatgacaaaatatctttatatcattacttacaaatgtatatagaatatttagaaaataataaaattattaaaggctattggataactatgaaattaaaagataatgatataacagtgatatttggagttaaaattaaaactccttataatataaataaaatatatatgataaaaagtataccagtttcggtttctaaaggtaaaataagtaacataaatttagagatagaagatgttaaaatgtataataataatttggaagaacaaaatggttatagattaaaattctatattgatagtgtcacagattttattaattttgatacgagagatgtttatctggaattaggtccgtggtttacgtataattcgtttggcatacaatttgctgaatattctattagacgtagattagtttcgtctacaaaagaaaaaagtatggaaatatgttatataatattatcgaaattgatgtgtttatcttccgaaatgtataatataaaaagaataagagagggtaaacaaaatgttataaaatcagcaatacatggtagttcggatgctataacaacagctgcatataataatataatagatccaaacaatgatatatattctcaaatattatcaagtcaaattatgaaattaggacatggatattatgattgttatttaaatttaaatagatatgattctattaacataaattctgtcaccgaacaagatataaatataacaagtgaaataattgaaaatttctaa

SEQ ID NO: 61 - DNA, 483 bp, Amsacta moorei entomopoxvirus
  exon (1)..(483)
atggaaagaagtttacaaattataaataatacaacatctacattatctagaataacatcaccaatcgataatattagatatatttttgatcttattaacacaagtggtaatggtgaaattacggcagaagaattactaaattttttaattgttattgatccaactataaatttatctgatgttcgtgcgttaattgccacatatgatttgaataataacaatacgttaagttttgatgaatttgttccaataataggtattaatataactgatgaaaaattaagagaagcatttgattctataacaactgatggtgatgtcgatcttgataaatttagaacatattataatttattacaaattactcccatatatagacatactaacgatcaatatatagatataataattagaatgatcggaagtagtcaagaagaatttatagcattttggaattacataaatactcaagtaaatggataa

SEQ ID NO: 62 - DNA, 540 bp, Amsacta moorei entomopoxvirus
  exon (1)..(540)
atggacaataatacaattactaaacatattggctataatactttacaagttgttacagaaatttctattcaattagaaagcaaacaaataaataataatattagacaagaaattgtatcaaatataaaaaataatataataaataaaactagcggtgttaattatattttatcagttgattatcaatcaatattaaataatgaattaccattattaagattaaataatgtatatacacaagaattagttgttaaattacccgtaacatatctatattttacaaaaaatcaaataataaaagcttatttgacaattattgaaggagataatccacatgtagttgcatataacaaatatatatattgtaatataattttagatcataatttcactataaatatgtcagaaaaattattaatatttaagaacaaagaatataaaaatagagatgaatgttatgtaaaaataatcgatatatatagttcagaaaaaaataataaaataccatgcaaaggtattttgcaagacgaagaaatataa

SEQ ID NO: 63 - DNA, 735 bp, Amsacta moorei entomopoxvirus
  exon (1)..(735)
atgaataacatttcatataaaaattttatcgaaaatataccagaaaaatggttagatgtgatagataaaaaacaattagaatatgctcatcataaattaaaaaatgaatctattattaaaccatctataaataatatatttaaatgttttaaatattttaatcccgatcaagttaaagtaattattttaggtcaggatccttatcctactgttggaatggctgatggtttagcattttcctgttctaataatagtaattatattcctaaatctttacaaaacataataaaagaaatattaaaacaaaataaaaaatatgatatgatgaaaaatattaatatgaattatattaatgtaaatctagaatttttagcgaaacaacaaattttattatttaatacgatattgacagttggtgatgagccaatgtcacacaaacatatttgggaatcattttcaaattctattattaaaaaattatcattaattaataataatatagtatttatattatttggtgcaaaagctcataataaaatttattttatcgaaaataaaaaaaatcattgtattatcaaaacaagtcatccttctaatttatcttgttataaagatggatatgataaatatgttccttttaataattcagattgttttaatatttgtaacgaatatcttataaaaaataatataaaaccgatagattggttatctgaattaataaaaaataattaa

SEQ ID NO: 64 - DNA, 714 bp, Amsacta moorei entomopoxvirus
  exon (1)..(714)
atggaaaattatgattttaaaattgataaatatactcatataggaaatcgtagttataacgatgattatatatttataaaaaaaaatataaattatatcatgtttgtaataattgacggacacggaggttcagaatgttctaaaatatttataaaattatttaataaaaattttaatccaaaaccatatgtagatattggattatatataaaaaatttatttataaaaattaataaaacaattttaaataataaaattacatctggagcatgtgtatctggtatttatattgataataataaaacaataatatttcaattaggagatacaaaaatatatttatataataacaataaattaacatatgaaacaatacaacatgatatatcaaataaatacgaaagaaataaattttttaaagattttatttattcagatattccaagattatttggaaagttaacagttacaagggcaataggaaattttgatttaaatataaaatatatacctaaaatagattatatttctaataatagttataataaaattattttatgcacagatggagtgtataaaaaaataaatataaatatcgatgatactgctaaagaaaatattaataaatgtttaaaaaatcctcctaatgataatatgactatgatgattataaatttatcaaatatattacatttaataaataaaaacatataa

SEQ ID NO: 65 - DNA, 474 bp, Amsacta moorei entomopoxvirus
  exon (1)..(474)
atgttaccttataaatggaataattattttgcacacggaactataataaagtgtataaatacaatatgtttcaaacttccgtgcaatggtactgaatgggatatatgtaaattaataaatacttttcctaatttaaaaattgtaatagattttagatattcagaaacatgttataatccatctgatcttaataaattaggtatagaatatataaaaataccaataaaagcacaatctttaccaacagatgataaaataaataaattttttaatattattgataaatatattgaattaaaatatttaataggaatacattgtactcatggcattaatagaactggatatatggtttgtaaatacttaatatataaatttaaaattccaccttatgttgctataaatattttcgaaaaaaatagaggatattatatagaaagagaaatatatataaataatttattatatttttaa

SEQ ID NO: 66 - DNA, 870 bp, Amsacta moorei entomopoxvirus
  exon (1)..(870)
atggaaaattatcatattattatattaacaattaaaagaaattctgacagattacaaaaactagaaaatatattatcttgtcaaaatttattatataataaagattatagtgtattttatggaatagattataaaaatataaataaaaataatttaaaaaatatatgtaaaaaaggatttaaaaacacatgtccttattcaactttagcatgtgcgtcatcacatattctattatggaaatatatatcaaaattaaaagataaatataaatatattataatattagaagatgatacatatataaatgtatcagagtataataaacatacaaatacagttgaagaattattaaaaaataatagtatagtatttttatattctgattgttatataatgggaactaccatcaaatcaaccaacaatgatacaaaaataacatataatccaaagtttcacgtttcgatgggttgttattgtataacaccaatcactgctactaaattatattatttctatataaaatctagagtatggttccacatagattttcaattaaattttgatatacataatatatcattaaatagatatatttatatagctgctaatgtatgtaatcaatatgaaggaaataaatcatctatgggtttaaaacataataatataatgttaatacctatagaaaatacaaaattaatgagaataatatcgactcctattataagagttaatgaagctgaaatagatttttatataataataatgttaatctcacttatcgctagtttatatttctttggttttaatatttctgccttaatatttttattatttatagtagtagatgttgcggagaatgcaaaaaaataa

SEQ ID NO: 67 - DNA, 1830 bp, Amsacta moorei entomopoxvirus
  exon (1)..(1830)
atgaatataaaattattaaaaaatggaatgcgaattattaataataattttgataataataatttaataaatatatctataaataattttggtcaaaatttatcaatatattataagaattataagttaatacatctcatagaacatatattagtatcaatgctaatagtatatacaggtgaattatcattttggaacggatatacaaattcaaataatattaatatatattataataatataatgaatatatcacataataaaataattgatgcgatacttcgtttatttaataaaaatggtatttttgttgatgaaaatataataaattataaatttttagaaaatgaaaataaaatattaaataatgaaaaaaattttagattattaacagataaatatgaaataaatcctatattatatcttttaacaaatgatgtttatttagaagaaaataatcaaaaaataatatctgatgttaaatttattaatgatgtattgtcggatattaatgtgtcagatattatattttatacttcaaatacagatttttttaatatattatatccgcgattagataaaataatttttaataaaactaaaaataaaaaaaataaatttctaacattacccatttataaatctagttttaaaaatagtatatatttattttctttcgatcaaaataatagatattatagtataactattaaatttaatttattaaaatatgttataattggatatatgattgataaatattattataataaattagtattaatcaatatattatccgataaattattatctttaactatatattttttaacaagtgaatatatgtataaatcattaaattattttgaaactatagattattctaaaataaaaaaattagaatttgatgattatgtaatattaaatgaatattttgatattataaatatttataataatataaaaagtaataatataaataaatattattcttattataataaatatattgattatattataaattcatctacagatataaataaattttttttacaaatacctaatcaactatatttaaataatgaatttgatattaataatattcctgtttttaaagcagaaacattatttaatagtaaaataaacacaaataataaaaataaaataacaaatattaataatatagaaatattaaattttaatgttaataatatgatattttttatgaatgttattgaagataaatttgaaataaaaaataatgaaataattataaaaaatacaaaaaatatatataaatcagataataatatatgtgtgcttaataataattataattatcctaaaatatatttttattataaatattttataatttactttttttctaatatatttttaaatattgacgatgctatagaatatgtaaaatataaaccttattttaatttattaaataatattaatgtagaaaataattttaacacaaatatattaataaataataaaaaaataaacataaatacaaatcatgatttcataacagcattatacatatataattgtaataataaaaattgttatatacatatggctactatttcagatatattaagagatctcggattaatatacacccctattattaattttgaaaataatctagtttatttatttataataacaaataaaccacatgaaactgaaatacatttaagaaaaatattaaatgataaatttaatgtaaataatgttattacaataatatcaacaaaaggaaactataacactaaagaattattaaataaatacataaccttcaattaa

SEQ ID NO: 68 - DNA, 741 bp, Amsacta moorei entomopoxvirus
  exon (1)..(741)
atgggagcgtccgcaagtattaatactattgtgtctgatataactaatagagttgaaaattcattaattcaaacagcaaatgcctctgcacaagcaatatgtcgagtaacaattggaagtattagttttagatccacacagggatgtactatagaggtaagaaatttatgtagtgcgcaagctgtagcacaagttgacgctgtagtaaatgcaactattgatttttataataatttaacttttgaacaaaaacaagaagcacctacgtggtttacagtagcttatggaataaatactactgtaactactatcgaaaatgattttagaaatttagttgaacaaagatgtaaatctcaagctgttttagatagtagcataacagttgataatattttagttaatgattgtagagcaccaggaaatgaaatagttagatttacatttgttaattctggaacggctgctggacaatgtgcaatatctgctctattagatttacaagtagcgggttctaatcaagtaagtgctagtcaaagtcaaggtttaaatataggaaatataatattatatgtagcaatagcaattattgttattgcaatatcatatgttttaataaaattttttggtaataaaccaacaataaaacaacaaattagtttagaattagctaaaaatggagcagtgtctagtcaattaatacaattatcgagatatgtatctaaaatagatgatagagattga

SEQ ID NO: 69 - DNA, 831 bp, Amsacta moorei entomopoxvirus
  exon (1)..(831)
atgactttagttaaacataatacgatgcataattttttacattcaaaatcaaatatatctgaattagattatagtattgaatcttcgtcagaaagaagagatataattataaaaaaatacgatacattaaatataaaaaattataatagaaaaacaagttttaatgctatattaataacaagcgataataaaattattattgcagaaagaaaatttagctattatatggacacaatatatataatatctacatataaaaatatatctgatgatatattagaaacatttattaaattatttgataaattaactaataaagaaaaatataatatatataataaaaaaagaataaataaaaaatatatttcaattataaattttattgaagtatatttcgatggtaatataaatcataaatatttacaatatttatataatgtaaaatctagaattatattaaataataattttagatacagagataaatttttaattttacctggtggtaaaaaaaataataatgaaaatattaatgaagttataagtcgagaatcacacgaagaaataaatattcctataaataatcaagataataataatattgatataatgcaagactattattcagaaactataatatttgataaaatactttcaaaaaaatttattgatgttactattatagcaaaaatcaaatatagttctattcaaatattaaatttctttaaacccaatcatgaaattagtaatattaaatttatacctattaataaaataaattcgatgattgatatattttattatgtacaaaaacaattaatctattgttaa

SEQ ID NO: 70 - DNA, 1002 bp, Amsacta moorei entomopoxvirus
  exon (1)..(1002)
atgaaaaaaaaatataataatacatacaagattatagaagaaaaaatttataatacggatggacaagaaatagtagacgataatttattaaatattataaagaaatataaacctcccaaacatcttaataatatagaattaatagctaaaaatatcgaggaagctgacaacggtataatatatattggtattgatagtaaaaataaaaaacaatatatttacggaataaattacgtaaaaaaaagaagaaatgacagaataaaaatatttttaaaagtagaaaataaaatacctaaaatagaaaaatatattaataaagaattgaatatattcaaaaaaaatggtagtaattcatcacacatatacataactgataaaatgatttttgctattatattattagtagaaatgtgtttttttataagaactggaaaaaaaaaatatttagaagataatgaaactatcggattattgacattacaaaaaaataattttacaatagaaaatgatgttatatatataaattttaaaggaaaattatctcaaaatcaaaattttagcatattaaaagatgagcatttattaatatacaatatgattaaaatattatataataagactaatgattttatatttaaaaatagtgatgatataatatttaatgaatctaaattatattctatgattaaacaatttaatataaagttaaaagatataagaacatttggagttaatagagttttaatacaagaattgtggaaaaatgttagagatttagatattatggatattaggcataaagatataaaaaaaataatatcagaagtagttaaaagaacagctaatataattggtcatacaccaactatatccaaaaatagttatatagtagatgaaataagatctataatagataaagatactataaacaaagctaaagaaatgacatttgatgaatattataaatatattgtagataaattaaaagaattaaccaattaa

SEQ ID NO: 71 - DNA, 1161 bp, Amsacta moorei entomopoxvirus
  exon (1)..(1161)
atgggtggtagagtaagtatatcgtttataagaccagagaataataataatggaaataaaaatttattaataggtttaagtgataataacatagttagagttccgatgtttgaacaaattaatagaataccaagatcggcttatgaaaatctcgacgaatatgaaataaattattgtattggaactccatttaattctttggcagaatgtgcattattatttaataataatattttgtctaattatacaagcgaattagataattatgtaataactaacgaaggatcgccgtgtactagtttaacatttaggccgggaagtatattatatggtaattcagaatggttagaaggtagaacatttgttggaaataaatgtaaaataagatatagaggatatccaatatatgaaaatgatttgcgggaatgttgtactggtaaaagaacatctggttgtcacgaaacattaataaataactttacaacaccacattgtaatgtaacaatgcaaaatttttgcagacaaaatccggaagatttatattgctatagatggatgtatagccaatctaaaacatttgatattgctttaaaattatattcagaattatgtagtatagatcatactaaattatattgtgattatatgtgtgtgtatgcgagagaaaatggatatccaggatattgtgatgattcgttgtcaaactggtgtaaaaataatagtaataattcgttatgtttttgttataatcctcctactgaatttataccagatgttgaagaagttttgggtccaaaagaatgttggttagcgccatgtactgtctcttatagtggtcaaaaatggttaacaaccaatcagatgaatataaaaaaaaattgtaatatacaatcttgtattataaccataggatcattgttaactagaggtaataataaaattgatttaataaataattgtataaacaatttaaacgcaagcacagtaataaattcagaaaatttatcaaatgtcactgatataaaaataaatcaaacatggggagtatttttcgatcctgttatatttattttaataatatttatatttatattgataatattatatttttataataaaaaaccaatatatactattaatataagtgaaactaatttataa

SEQ ID NO: 72 - DNA, 423 bp, Amsacta moorei entomopoxvirus
  exon (1)..(423)
atgttaagtaattatgaaaatgataataaaatgatagaatattgtaataataataaagatgatataaaatgtcaatgtttaatagtgaatgataatatcgatgtattttcaaaatcatcatatgcgccatatttttgttggtattctgcgtgtagaaataatgaaaactatattactagtttaataaaaagtgaacaacaatattgtaatattacagtgtgtgaaattagtgttacagatatagtattaaatgacaatggaaatttaactgtaacaaacgaatgtgctagtaacataaatcctatatattcattatctcaaattatagttaatttaacgtcatttgacataccaaatttatttgtaagttttttttatccgatagttattattatatcaattttaatattttttaaaaaataa

SEQ ID NO: 73 - DNA, 747 bp, Amsacta moorei entomopoxvirus
  exon (1)..(747)
atgaatgaatcgcaattacaaaccagaaatagtagtattaatataggtagaactatatttaatgacgtatatactagatttatcgataaattaaatagaatatctagtacaacaaatattaattgtaatataaatataaatgaaataagaacaagtaatattaataattgtaatatagttttaagtaataaatgtgttagtaatgaaataactagttttacattattattacaaagtttaggagaaactatgttactattaccagaagacagacgcacacaaatagaaaatatattaggaatatccacagatgatataataaatgaaaatgatactggattcataaataattgtagagcaagtgcagtagtggacaatagtataaatatcggtactatagaaataaatgattgttattctaattttcctactgatttcttatttttaaatgcgggttctgcggatgctaattgtggaataaaatatatatcagatgcattactaaaattagataatagaaaaccagaattatcattgcaattattgtttaatataaaaatgatagattatataataatattaataactattttatctatatatatattatttatttttatgtcatttttaataccaagaaataaaaaatctatctattattctagaaatactattcttaataaaaatgataaaatcttagaaaatatttatttgagacattacgatgggatcaataattttatatga

SEQ ID NO: 74 - DNA, 1011 bp, Amsacta moorei entomopoxvirus
  exon (1)..(1011)
atgggaggcagtgttgacatcgaagctagatatactggttcctctaattttcaagaaacatatttgtcattttcaaatttaattaatactatatatatattaacaagagatgaaagaataccaataggtatattttcaaacaatcctgatgattacagaaattatcgaggatatactgctatatttaaaccaggcggatataaagaattattgaaagtaaatgacttaggacccgatgacttgtgttgtatttatgattggagatatgcttgggttgatgaaaataatatattatcacaaaacgcaagtgtaaataaaaatttatttacgtgcgatcctagaactatacaagtaggaactaataatatttgtgataattcgatgtatagagcttgtatattagattttaataatcatagatatttagaagcgaaatgtggtgtttggttagatggtttatttaaaagatttgcaacagcttcaaatattataaataatacaaataatatactattacaatcgtgttctaataatattaataatgatttgtgtataaaatggttaatagcaataagaaatagcggaaatcctacatttttttcattagcagataatgttttaaacgcacaaacagataaaacaaatttaaaatgtgctttttctccttcatatattacagatacacaaaatagattaaatgttccaaaagaatgttggtatagagagtgtgctttttcaccaaattatctattattaactgacaatataacattaaaaaataattgttcattgtctgaatgtaatataaatatcggaaatttagatatagtatctgcgtcagaagtaacaataacttgcaataataataaatcaaatactgtatcatcaagacaaaaattagatatattattgagagaatcagaagattatagatttttgttaactaacaacattttaatattaattttattatttatatttttaatatttttaataattagacataattaa

SEQ ID NO: 75 - protein, 293 aa, Artificial Sequence
  HaEPV from Figure 10
MSFNPIIYYISDIKNERPYKKNTKPYIFNFRKPGQIKLLINEIRFLTEDVEIYKNYNNKIINILYIGSGKGYHIPLLMEIYSKYNIIWHLYDPNGHCDKLNEISNKNNNVNIYNQIFDKKDVELYEDVQNLLFISDIRTIDDDKIEPNTKNLIHDYDIQNYVLKQLKPIALIKQRDPFPNDWDESYEMYIPDGKEYVQCFQKHDSAEYRIFVCGATTFTKVNLDVLKTRNIDKKLAWYNTKYRFDNFNDYRIAYRVLNKYLKTENLPFLKYTDINKNNIKSVIKSISKTINDN

SEQ ID NO: 76 - protein, 295 aa, Artificial Sequence
  MSV041 from Figure 10
MSIYMKINDFKKPNVLIFDNINNQLKYKPNNVSNKHPGQLKLLMTELQFFNNCNIDALNSKDRPIYVLYIGSGRGYHLIKLLDLYKDYNIKWYFYDPSGHCISLERMSQYVSINNDYFTEKNINEFKNKKPLLFISDIRSTDGSEPRTKNLIDDYKIQNNIVLNLRPLYSLLKFRYPFPDDFPPEIENEVYVDGIKFLQPFCGPQSTEMRIFVSEQNIILKNFSKEESILFEEKMYYYNKNYRIINKNDILIAGFILKSTNKFDNMKYIDIIKSLENSINNQIREDISFNKLDIK

SEQ ID NO: 77 - protein, 333 aa, Artificial Sequence
  VVJ3R from Figure 10
MDVVSLDKPFMYFEEIDNELDYEPESANEVAKKLPYQGQLKLLLGELFFLSKLQRHGILDGATVVYIGSAPGTHIRYLRDHFYNLGMIIKWMLIDGRHHDPILNGLRDVTLVTRFVDEEYLRSIKKQLHPSKIILISDVRSKRGGNEPSTADLLSNYALQNVMISILNPVASSLKWRCPFPDQWIKDFYIPHGNKMLQPFAPSYSAEMRLLSIYTGENMRLTRVTKSDVVNYEKKMYYLNKIVRNKVVVNFDYPNQEYDYFHMYFMLRTVYCNKTFPTTKAKVLFLQQSIFRFLNIPTTSTEKVSHEPIQRKISSKNSMSKNRNSKRSVRGNK

SEQ ID NO: 78 - protein, 30 aa, Artificial Sequence
  Consensus from Figure 10
PNYLFYIGSHLIWDIDLYQNLPKGSRKNNY

SEQ ID NO: 79 - protein, 46 aa, Artificial Sequence
  Insect Cons from Figure 10
PNYLFNLYIGSYHLYIWYDCFLIDLYQNLPLKGSRKYNNDILNYIK

SEQ ID NO: 80 - protein, 80 aa, Artificial Sequence
  AmEPV Cons from Figure 10
PYYDNYDNNKKLIFLNNNILYIGSKYHLYIQWYDCNIFDLIDDDNLYQNILPSLKNWSGYSRIKYNNDIILNKNYNIKKI

We claim:

1. A method for delivering a polynucleotide encoding a protein to a vertebrate cell, said method comprising introducing into said vertebrate cell in vitro a recombinant entomopoxvirus vector, wherein said entomopoxvirus vector comprises said polynucleotide operably linked with a heterologous early poxvirus promoter sequence or a non-poxvirus sequence, thereby delivering and expressing said polynucleotide encoding said protein in said vertebrate cell.

2. The method according to claim 1, wherein said vertebrate cell is a mammalian cell.

3. The method according to claim 1, wherein said mammalian cell is a human cell.

4. The method according to claim 1, wherein said vector comprises inverted terminal repeat sequences flanking said polynucleotide encoding said protein.

5. The method according to claim 4, wherein said inverted terminal repeat sequences are derived from adeno-associated virus.

6. The method according to claim 1, wherein said promoter sequence is capable of driving expression of said polynucleotide encoding said protein.

7. The method according to claim 6, wherein said promoter sequence is selected from the group consisting of a CMV promoter sequence and herpes TK promoter sequence.

8. The method according claim 1, wherein said protein encoded by said polynucleotide is selected from the group consisting of interleukins, cytokines, growth factors, interferons, enzymes and structural proteins.

9. The method according to claim 1, wherein said vector is introduced into said vertebrate cell by infection in a viral particle.

10. The method according to claim 1, wherein said vector is introduced into said vertebrate cell by means selected from the group consisting of transfection, transduction and injection.

11. The method according to claim 1, wherein said polynucleotide encoding said protein is greater than about 10 kb in size.

12. The method according to claim 1, wherein said polynucleotide also encodes a selectable marker protein.

13. A recombinant entomopoxvirus vector comprising a polynucleotide encoding a protein operably linked with a non-poxvirus promoter sequence; and inverted terminal repeat sequences flanking said polynucleotide, wherein said non-poxvirus promoter sequence is activated by the cellular RNA polymerase of a vertebrate cell.

14. The vector according to claim 13, wherein said entomopoxvirus is *Amsacta moorei* entomopoxvirus.

15. The vector according to claim 13, wherein said inverted terminal repeat sequences are derived from adeno-associated virus.

16. A recombinant entomopoxvirus vector comprising a polynucleotide encoding a protein operably linked with a CMV promoter sequence or herpes TK promoter sequence, wherein said CMV promoter sequence or herpes TK promoter sequence is activated by the cellular RNA polymerase of a vertebrate cell and is capable of driving expression of said polynucleotide.

17. The vector according to claim 13, wherein said protein encoded by said polynucleotide is selected from the group consisting of interleukins, cytokines, growth factors, interferons, enzymes and structural proteins.

18. A recombinant entomopoxvirus vector comprising a polynucleotide encoding a protein operably linked with a non-poxvirus promoter sequence, wherein said non-poxvirus promoter sequence is activated by the cellular RNA polymerase of a vertebrate cell, and wherein said polynucleotide encoding said protein is greater than about 10 kb in size.

19. The vector according to claim 13, wherein said polynucleotide also encodes a selectable marker protein.

20. A viral particle comprising the vector of claim 13.

21. A vertebrate cell comprising a recombinant entomopoxvirus vector comprising a polynucleotide encoding a protein operably linked with a non-poxvirus promoter sequence, wherein said non-poxvirus promoter sequence is activated by the cellular RNA polymerase of said vertebrate cell.

22. The cell according to claim 21, wherein said cell expresses said protein encoded by said polynucleotide.

* * * * *

UNITED STATES PATENT AND TRADEMARK OFFICE
CERTIFICATE OF CORRECTION

PATENT NO.     : 6,933,145 B1
DATED          : August 23, 2005
INVENTOR(S)    : Richard W. Moyer and Yi Li It is certified that error appears in the above-identified patent and that said Letters Patent is hereby corrected as shown below:

Title page,
Item [*] Notice, "Subject to any disclaimer, the term of this patent is extended or adjusted under 35 U.S.C. 154(b) by 0 days." should read -- Subject to any disclaimer, the term of this patent is extended or adjusted under 35 U.S.C. 154(b) by 0 days. This patent is subject to a terminal disclaimer. --.

Column 1,
Line 50, "cup genes" should read -- cap genes --.

Column 4,
Line 14, "concernscells" should read -- concerns cells --.
Line 36, "phololyase" should read -- photolyase --.

Column 5,
Line 45, "30 min. then" should read -- 30 min, then --.

Column 6,
Line 24, "genome, (A)" should read -- genome. (A) --.
Line 50, "Brief Description of the Sequence" should read -- Brief Description of the Sequences --.

Column 8,
Lines 45-46, "phosphorylase 1 (NPH I)" should read -- phosphorylase I (NPH I) --.

Column 9,
Line 30, "consenus" should read -- consensus --.
Lines 37-38, "proteins. (2)" should read -- proteins, (2) --.

Column 10,
Line 65, "such as lucZ" should read -- such as lacZ --.

Column 11,
Line 24, "excellent-vector" should read -- excellent vector --.
Line 40, "expression of AMEPV" should read -- expression of AmEPV --.
Line 47, "as a sector" should read -- as a vector --.

Column 12,
Line 50, "repeals" should read -- repeats --.

Column 13,
Line 12, "Ba$^a$" should read -- aa$^a$ --.

UNITED STATES PATENT AND TRADEMARK OFFICE
CERTIFICATE OF CORRECTION

PATENT NO. : 6,933,145 B1
DATED : August 23, 2005
INVENTOR(S) : Richard W. Moyer and Yi Li It is certified that error appears in the above-identified patent and that said Letters Patent is hereby corrected as shown below:

Column 15,
Line 19, "AF063886" should read -- AF063866 --.
Line 29, "AF021176" should read -- AF022176 --.
Line 38, "69546-68505" should read -- 69548-68505 --.
Line 52, "helicase (tBR)" should read -- helicase (I8R) --.
Line 54, "82" should read -- 62 --.
Line 55, "76827-77028" should read -- 76627-77028 --.
Line 60, "AF083866" should read -- AF063866 --.
Line 63, "83288-82440" should read -- 83228-82440 --.
Line 63, "AF083868" should read -- AF063866 --.
Line 76, "90120-69695" should read -- 90120-89695 --.

Column 16,
Line 7, "808" should read -- 608 --.
Line 23, "288" should read -- 286 --.

Column 17,
Line 54, "128909-130115" should read -- 129909-130115 --.
Line 77, "F. neoformas polyubiqurtin" should read -- F. neoformas polyubiquitin --.
Line 77, "ubiqurtin" should read -- ubiquitin --.
Line 78, "148669-146316" should read -- 146669-146316 --.

Column 19,
Line 9, "MSV113 VETF-3 (D6R)" should read -- MSV113 VETF-s (D6R) --.
Line 11, "HaEPV orf5" should read -- HaEPV orf6 --.
Line 41, "MSV162 NAD-dep DNA ligase" should read -- MSV162 NAD+dep DNA ligase --.

Column 20,
Line 33, "874" should read -- 674 --.

Column 21,
Line 6, "198415-195996" should read -- 196415-195996 --.
Line 15, "200248-198973" should read -- 200248-199973 --.
Line 33, "298261-208905" should read -- 208261-208905 --.

Column 22,
Line 61, "co-linearcore" should read -- co-linear core --.
Line 64, "(VV)." should read -- (VV), --.

UNITED STATES PATENT AND TRADEMARK OFFICE
CERTIFICATE OF CORRECTION

PATENT NO. : 6,933,145 B1
DATED : August 23, 2005
INVENTOR(S) : Richard W. Moyer and Yi Li It is certified that error appears in the above-identified patent and that said Letters Patent is hereby corrected as shown below:

Column 23,
Lines 38-39, "*Virol.* 71 :9557" should read -- *J. Virol.* 71:9557 --.
Lines 48-49, "Hoia-Mitchell" should read -- Hota-Mitchell --.

Column 24,
Line 47, "Identification.cloning" should read -- Identification, cloning --.

Column 26,
Line 6, "533-552.) 6kb" should read -- 533-552), 6kb --.

Column 29,
Line 13, "181" should read -- 161 --.
Line 66, "lyrosine" should read -- tyrosine --.

Column 31,
Line 40, "Am EPV" should read -- AmEPV --.

Column 32,
Line 42, "MSV 196" should read -- MSV196 --.

Column 33,
Line 12, "residues. AMV076" should read -- residues, AMV076 --.

Column 35,
Line 16, "2'-methylation" should read -- 2'O-methylation --.
Line 66, "Y-1-G-S-X-X" should read -- Y-I-G-S-X-X --.

Column 37,
Line 52, "Vileinskas, A." should read -- Vilcinskas, A. --.

Column 38,
Line 14, "inflamnation" should read -- inflammation --.
Line 17, "Serpins. In" should read -- Serpins, In --.

Column 41,
Line 63, "associate Keith" should read -- associate with --.

Column 42,
Line 4, "reaction. PCR" should read -- reaction, PCR --.

UNITED STATES PATENT AND TRADEMARK OFFICE
CERTIFICATE OF CORRECTION

PATENT NO. : 6,933,145 B1
DATED : August 23, 2005
INVENTOR(S) : Richard W. Moyer and Yi Li It is certified that error appears in the above-identified patent and that said Letters Patent is hereby corrected as shown below:

Column 54,
Line 61, "50 µI total" should read -- 50 µl total --.

Column 55,
Line 53, "Oligonucleotideprimers" should read -- Oligonucleotide primers --.

Column 57,
Line 20, "muzyczika" should read -- muzyczka --.
Lines 42-43, "modification oft an" should read -- modification of an --.

Column 59,
Line 8, "factors in trains" should read -- factors in trans --.

Column 60,
Line 66, "gene transfervector" should read -- gene transfer vector --.

Column 61,
Lines 17-18, "IFN-'/β.IFN-(.TNF" should read -- IFN-"/β, IFN-(,TNF --.

Column 63,
Line 12, "according to claim 1" should read -- according to claim 2 --.

Signed and Sealed this

Thirteenth Day of June, 2006

JON W. DUDAS
*Director of the United States Patent and Trademark Office*